US008828694B2

(12) United States Patent
Anthony et al.

(10) Patent No.: US 8,828,694 B2
(45) **Date of Patent: *Sep. 9, 2014**

(54) PRODUCTION OF ISOBUTANOL IN YEAST MITOCHONDRIA

(75) Inventors: Larry Cameron Anthony, Aston, PA (US); Lixuan Lisa Huang, Hockessin, DE (US); Rick W. Ye, Hockessin, DE (US)

(73) Assignee: Butamax Advanced Biofuels LLC DE (US)

( * ) Notice: Subject to any disclaimer, the term of this patent is extended or adjusted under 35 U.S.C. 154(b) by 662 days.

This patent is subject to a terminal disclaimer.

(21) Appl. No.: 12/617,017

(22) Filed: Nov. 12, 2009

(65) Prior Publication Data

US 2010/0129886 A1 May 27, 2010

Related U.S. Application Data

(60) Provisional application No. 61/114,073, filed on Nov. 13, 2008.

(51) Int. Cl.

| | |
|---|---|
| ***C12P 7/04*** | (2006.01) |
| ***C12P 7/18*** | (2006.01) |
| ***C12N 1/00*** | (2006.01) |

(52) U.S. Cl.
USPC ........................ 435/160; 435/157; 435/254.11

(58) Field of Classification Search
USPC .......................... 435/157, 160, 252.3, 254.11
See application file for complete search history.

(56) References Cited

U.S. PATENT DOCUMENTS

| | | | |
|---|---|---|---|
| 4,683,202 | A | 7/1987 | Mullis |
| 8,465,964 | B2 | 6/2013 | Anthony et al. |
| 2007/0031918 | A1 | 2/2007 | Dunson et al. |
| 2007/0092957 | A1 | 4/2007 | Donaldson et al. |
| 2008/0261230 | A1 | 10/2008 | Liao et al. |

FOREIGN PATENT DOCUMENTS

| | | |
|---|---|---|
| WO | 2007032522 | 3/2007 |

OTHER PUBLICATIONS

Altschul et al., J. Mol. Biol., 215:403 410 (1990).
Bianchi et al. Mol. Microbiol. (1996) 19(1):27-36.
Deshpande. Appl. Biochem. Biotechnol., 36:227, (1992).
Dickinson et al., J. Biol. Chem. 273(40):25752-25756 (1998).
Flikweert et al. Yeast (1996) 12:247-257.
Frohman et al., PNAS USA 85:8998 (1988).
Garcia et al., Process Biochemistry 29:303-309 (1994).
Guo et al., J. Membr. Sci. 245, 199-210 (2004).
Higgins and Sharp, CABIOS. 5:151-153 (1989).
Higgins et al., Comput. Appl. Biosci., 8:189-191 (1992).
Hohmann, Mol Gen Genet. (1993) 241:657-666.
Hurt et al. EMBO J. (1984) 3(13):3149-56.
Loh et al., Science 243:217 (1989).
Mnaimneh et al. ((2004) Cell 118(1):31-44.
Ohara et al., PNAS USA 86:5673 (1989).
Sulter et al., Arch. Microbiol. 153:485 489 (1990).
Tabor, S. et al., Proc. Acad. Sci. USA 82:1074 (1985).
Van Ness et al., Nucl. Acids Res. 19:5143 5151 (1991).
Wach et al. (1994) Yeast 10:1793-1808.
Walker, et al., Proc. Natl. Acad. Sci. U.S.A., 89:392 (1992).
W. R. Pearson, Comput. Methods Genome Res., [Proc. Int. Symp.] (1994), Meeting Date 1992, 111 20. Editor(s): Suhai, Sandor. Plenum: New York, NY.
Rychlik, W., In Methods in Molecular Biology, White, B. A. Ed., (1993) vol. 15, pp. 31 39, PCR Protocols: Current Methods and Applications. Humania: Totowa, NJ.
Sambrook, J., Fritsch, E. F. and Maniatis, T. Molecular Cloning: A Laboratory Manual, 2nd ed., Cold Spring Harbor Laboratory: Cold Spring Harbor, NY (1989), particularly Chapter 11 and Table 11.1.
Thein and Wallace, "The use of oligonucleotides as specific hybridization probes in the diagnosis of genetic disorders", in Human Genetic Diseases: A Practical Approach, K. E. Davis Ed., (1986) pp. 33 50, IRL: Herndon, VA.
U.S. Appl. No. 61/100,792 now U.S. Appl. No. 12/569,636, filed Sep. 29, 2009, titled Identification and Use of Bacterial [2FE-2S] Dihydroxy-Acid Dehydratases.
U.S. Appl. No. 12/477,942, filed Jun. 4, 2009, titled Enhanced Pyruvate to Acetolactate Conversion in Yeast.
Donahue et al., (2001) Nucleic Acids Res. 29:1582-1589.
Krogh et al., 1994; J. Mol. Biol. 235:1501-1531.
Margeot et al, (2002) EMBO J. 21:6893-6904.
Rothstein, Methods in Enzymology, vol. 194, pp. 281-301 (1991).
Horton et al., "Engineering hybrid genes without the use of restriction enzymes: gene splicing by overlap extension," Gene 77:61-8 (1989).
Van Nedervelde, et al., Proceedings of the Congress-European Brewery Convention, 29th, 50/1-50/10 (2003).
Office Action in related U.S. Appl. No. 12/617,039, now U.S. Patent No. 8,465,964, issued on Aug. 7, 2012.

*Primary Examiner* — Maryam Monshipouri

(57) ABSTRACT

Yeast cells with modified expression of certain enzyme activities in the mitochondria are described for isobutanol production. Modifications described provide an isobutanol biosynthesis pathway in the yeast mitochondria.

9 Claims, 1 Drawing Sheet

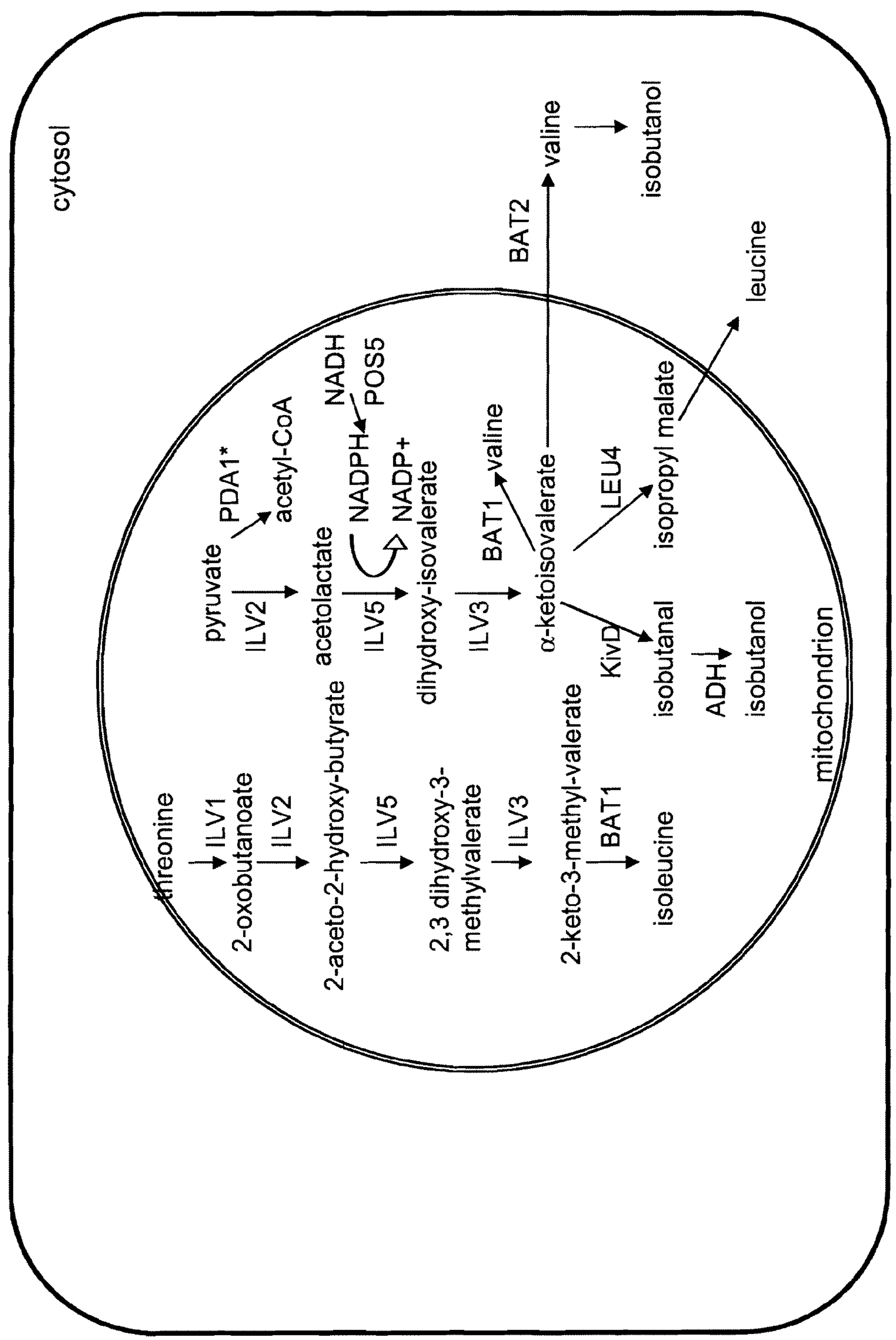
cytosol
mitochondrion
threonine
ILV1
2-oxobutanoate
ILV2
2-aceto-2-hydroxy-butyrate
ILV5
2,3 dihydroxy-3-methylvalerate
ILV3
2-keto-3-methyl-valerate
BAT1
isoleucine
pyruvate
PDA1*
acetyl-CoA
ILV2
acetolactate
NADH
POS5
NADPH
NADP+
ILV5
dihydroxy-isovalerate
ILV3
BAT1
valine
α-ketoisovalerate
KivD
isobutanal
ADH
isobutanol
LEU4
isopropyl malate
leucine
BAT2
valine
isobutanol

PRODUCTION OF ISOBUTANOL IN YEAST MITOCHONDRIA

CROSS-REFERENCE TO RELATED APPLICATIONS

This application is related to and claims the benefit of priority of U.S. Provisional Application No. 61/114,073, filed Nov. 13, 2008, the entirety of which is herein incorporated by reference.

FIELD OF THE INVENTION

The invention relates to the field of microbiology. More specifically, recombinant yeast strains are disclosed that are engineered for isobutanol production in the mitochondria.

BACKGROUND OF THE INVENTION

Butanol is an important industrial chemical, useful as a fuel additive, as a feedstock chemical in the plastics industry, and as a foodgrade extractant in the food and flavor industry. Each year 10 to 12 billion pounds of butanol are produced by petrochemical means and the need for this commodity chemical will likely increase.

Isobutanol is produced biologically as a by-product of yeast fermentation. It is a component of "fusel oil" that forms as a result of incomplete metabolism of amino acids by this group of fungi. Isobutanol is specifically produced from catabolism of L-valine in the cytoplasm. After the amine group of L-valine is harvested as a nitrogen source, the resulting α-keto acid is decarboxylated and reduced to isobutanol by enzymes of the so-called Ehrlich pathway (Dickinson et al., *J. Biol. Chem.* 273(40):25752-25756 (1998)). Yields of fusel oil and/or its components achieved during beverage fermentation are typically low. For example, the concentration of isobutanol produced in beer fermentation is reported to be less than 16 parts per million (Garcia et al., *Process Biochemistry* 29:303-309 (1994)). Addition of exogenous L-valine to the fermentation increases the yield of isobutanol, as described by Dickinson et al., supra, wherein it is reported that a yield of isobutanol of 3 g/L is obtained by providing L-valine at a concentration of 20 g/L in the fermentation. However, the use of valine as a feed-stock would be cost prohibitive for industrial scale isobutanol production.

Disclosed in US Patent Publication US20070092957 A1 is engineering of microorganisms for expression of several isobutanol biosynthetic pathways. Additionally Van Nedervelde et al (Proceedings of the Congress—European Brewery Convention (2003), 29th, 50/1-50/10) have demonstrated that deletions of the gene encoding the BAT1 mitochondrial protein in yeast resulted in strains having increased levels of higher alcohols. Similarly Nako et al (WO 2007032522) note that amyl alcohol and/or isobutanol and/or isoamyl acetate levels in yeast used for the production of alcoholic beverages may be altered via manipulation of the BAT1 and BAT2 genes. The art is silent with respect to the down regulation of other genes encoding proteins that are functional in the mitochondria for the enhanced production of isobutanol in yeast.

There is a need for attaining higher amounts of isobutanol through yeast fermentation without addition of valine or other isobutanol production intermediates.

SUMMARY OF THE INVENTION

Provided herein are recombinant yeast cells comprising a heterologous gene encoding a mitochondrial localized polypeptide having α-keto acid decarboxylase activity. In some embodiments, the α-keto acid decarboxylase activity is defined by the enzyme classification number EC 4.1.1.72.

In some embodiments, the cells produce isobutanol in the mitochondria. In some embodiments, the yeast cells comprise genes encoding mitochondrial localized polypeptides having ketol-acid reductoisomerase activity and dihydroxy-acid dehydratase activity which are overexpressed. In some embodiments, either one or both of the mitochondrial localized polypeptides having ketol-acid reductoisomerase activity and dihydroxy-acid dehydratase activity are heterologous to the yeast cell. In some embodiments, the ketol-acid reductoisomerase activity is defined by the enzyme classification number EC EC 1.1.1.86 and the dihydroxy-acid dehydratase activity is defined by the enzyme classification number EC 4.2.1.9. In some embodiments, the polypeptide having dihydroxy-acid dehydratase activity is a [4Fe-4S] or a [2Fe-2S] dihydroxy-acid dehydratase.

In some embodiments, the yeast cells comprise at least one gene encoding a mitochondrial localized polypeptide having acetolactate synthase activity which is overexpressed. In some embodiments, the at least one mitochondrial localized polypeptide having acetolactate synthase activity is heterologous to the yeast cell. In some embodiments, the acetolactate synthase activity is defined by the enzyme classification number EC 2.2.1.6.

Provided herein are recombinant yeast cells wherein the mitochondria is substantially devoid of a functional polypeptide having an enzyme activity selected from the group consisting of: threonine deaminase activity; isopropylmalate synthase activity, branched chain amino acid transaminase activity and pyruvate dehydrogenase activity.

In some embodiments, a) the threonine deaminase activity is defined by the enzyme classification number EC 4.3.1.19; b) the isopropylmalate synthase activity is defined by the enzyme classification number EC 2.3.3.13; c) the branched chain amino acid transaminase activity is defined by the enzyme classification number EC 2.6.1.42; and d) the pyruvate dehydrogenase activity is defined by the enzyme classification number EC 1.2.4.1. In some embodiments, the polypeptide having the pyruvate dehydrogenase activity is a multienzyme complex comprising proteins selected from the group consisting of: PDA1, PDA1, PDB1, LAT1, LPD1, and PDX1.

In some embodiments, the yeast cells comprise a gene encoding a polypeptide localized in the mitochondria having ATP-NAD (NADH) kinase activity which is over-expressed. In some embodiments, the ATP-NAD (NADH) kinase activity is defined by the enzyme classification number EC 2.7.1.86.

In some embodiments, the yeast cells are selected from the group consisting of *Saccharomyces, Schizosaccharomyces, Hansenula, Candida, Kluyveromyces, Yarrowia* and *Pichia*. In some embodiments, the cells comprise reduced pyruvate decarboxylase activity.

In some embodiments, the yeast cell is a *Saccharomyces* and wherein; a) the polypeptide having ketol-acid reductoisomerase activity has at least 80% identity to the amino acid sequence as set forth in SEQ ID NO 144; b) the polypeptide having dihydroxy-acid dehydratase activity has at least 80% identity to the amino acid sequence as set forth in SEQ ID NO 552; c) the polypeptide having acetolactate synthase activity has at least 80% identity to the amino acid sequence as set forth in SEQ ID NO:728; d) the polypeptide having threonine deaminase activity has at least 80% identity to the amino acid sequence as set forth in SEQ ID NO2; e) the polypeptide having isopropylmalate synthase activity has at least 80% identity to the amino acid sequence as set forth in SEQ ID NO 27; f) the polypeptide having branched chain amino acid transaminase activity has at least 80% identity to the amino acid sequence as set forth in SEQ ID NO 15; wherein identity of polypeptides recited in parts (a)-(f) is based on the Clustal W method of alignment using the default parameters of GAP PENALTY=10, GAP LENGTH PENALTY=0.1, and Gonnet 250 series of protein weight matrix.

In some embodiments, the cell is a *Saccharomyces* and wherein the polypeptide having ATP-NAD (NADH) kinase activity has at least 80% identity to the amino acid sequence as set forth in SEQ ID NO 720, based on the Clustal W method of alignment using the default parameters of GAP PENALTY=10, GAP LENGTH PENALTY=0.1, and Gonnet 250 series of protein weight matrix.

Provided herein are methods of making a recombinant yeast cell for the production of isobutanol in the mitochondria comprising the steps of: a) providing a yeast comprising mitochondrial biosynthetic pathways for the production of isoleucine from threonine and production of isopropyl malate, valine, and acetyl-CoA from pyruvate wherein the pathway for the production of isopropyl malate, valine, and acetyl-CoA from pyruvate comprises genes encoding polypeptides having the following activities:

i) ketol-acid reductoisomerase activity
ii) dihydroxy-acid dehydratase activity
iii) acetolactate synthase;
iv) isopropylmalate synthase activity,
v) branched chain amino acid transaminase activity;
vi) pyruvate dehydrogenase activity; and
vii) ATP-NAD (NADH) kinase activity;

and wherein the pathway for the production of isoleucine from threonine comprises at least one gene encoding a polypeptide having threonine deaminase activity;

b) introducing into the yeast of (a) at least one gene encoding a mitochondria localized polypeptide having α-keto acid decarboxylase activity;

c) increasing the expression of the polypeptides having ketol-acid reductoisomerase and dihydroxy-acid dehydratase activities; wherein isobutanol is produced in the mitochondria of the yeast cell. In some embodiments, the expression of the polypeptide having acetolactate synthase is increased. In some embodiments, the expression of the polypeptide having an ATP-NAD (NADH) kinase activity is increased.

In some embodiments at least one gene encoding a polypeptide having at least one of the following activities is down-regulated: a) an isopropylmalate synthase activity, b) a branched chain amino acid transaminase activity; c) a pyruvate dehydrogenase activity; and d) threonine deaminase activity. In some embodiments, the polypeptide having a ketol-acid reductoisomerase activity comprises a mitochondrial targeting signal sequence. In some embodiments, the polypeptide having a dihydroxy-acid dehydratase activity comprises a mitochondrial targeting signal sequence. In some embodiments, the polypeptide having a α-keto acid decarboxylase activity comprises a mitochondrial targeting signal sequence. In some embodiments, the polypeptide having a ATP-NAD (NADH) kinase activity comprises a mitochondrial targeting signal sequence.

Also provided are methods for making isobutanol comprising growing the yeast host cells provided herein under conditions whereby isobutanol is produced.

BRIEF DESCRIPTION OF THE FIGURES AND SEQUENCE DESCRIPTIONS

The invention can be more fully understood from the following detailed description, figures, and the accompanying sequence descriptions, which form a part of this application.

FIG. 1 shows branched chain amino acid biosynthetic pathways and an engineered isobutanol biosynthetic pathway in yeast mitochondria.

Table 8 is a table of the Profile HMM for dihydroxy-acid dehydratases based on enzymes with assayed function. Table 8 is submitted herewith electronically and is incorporated herein by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

TABLE 1

SEQ ID NOs of target proteins and encoding sequences for reduction

| Organism and gene name | SEQ ID NO: nucleic acid | SEQ ID NO: amino acid |
|---|---|---|
| *Saccharomyces cerevisiae* YJM789, Ilv1 | 1 | 2 |
| *Schizosaccharomyces pombe*, Ilv1 | 735 | 3 |
| *Candida albicans* SC5314, Ilv1 | 4 | 5 |
| *Candida glabrata*, Ilv1 | 6 | 7 |
| *Kluyveromyces lactis*, Ilv1 | 8 | 9 |
| *Yarrowia lipolytica* strain CLIB122, Ilv1 | 10 | 11 |
| *Pichia stipitis* CBS 6054, Ilv1 | 12 | 13 |
| *Saccharomyces cerevisiae*, BAT1 | 14 | 15 |
| *Schizosaccharomycs pombe*, BAT1 | 16 | 17 |
| *Candida albicans* SC5314, BAT1 | 18 | 19 |
| *Kluyveromyces lactis*, BAT1 | 20 | 21 |
| *Yarrowia lipolytica*, BAT1 | 22 | 23 |
| *Pichia stipitis* CBS 6054, BAT1 | 24 | 25 |
| *Saccharomyces cerevisiae*, Leu4 | 26 | 27 |
| *Schizosaccharomycs pombe*, Leu4 chromosome II | 28 | 29 |
| *Schizosaccharomycs pombe*, Leu4, NP_596103.2 | 30 | 31 |
| *Candida albicans* SC5314, Leu4 | 32 | 33 |
| *Candida albicans* SC5314, Leu4 | 34 | 35 |
| *Candida albicans* SC5314, Leu4 | 36 | 37 |
| *Candida albicans* SC5314, Leu4 | 38 | 39 |
| *Candida glabrata*, Leu4; XP_446653.1 | 40 | 41 |
| *Candida glabrata*, Leu4; XP_446566.1 | 42 | 43 |
| *Kluyveromyces lactis*, Leu4; CAH00792.1 | 44 | 45 |
| *Kluyveromyces lactis*, Leu4; CAG98836.1 | 46 | 47 |
| *Yarrowia lipolytica*, Leu4, CAA88928.1 | 48 | 49 |
| *Yarrowia lipolytica*, Leu4 | 50 | 51 |
| *Pichia stipitis* CBS 6054, Leu4, XP_001387341.1 | 52 | 53 |
| *Pichia stipitis* CBS 6054, Leu4, XP_001384536.2 | 54 | 55 |
| *Saccharomyces cerevisiae*, PDB1 | 56 | 57 |
| *Schizosaccharomycs pombe*, PDB1 | 58 | 59 |
| *Candida albicans* SC5314, PDB1 | 60 | 61 |
| *Kluyveromyces lactis*, PDB1 | 62 | 63 |
| *Yarrowia lipolytica*, PDB1 | 64 | 65 |
| *Pichia stipitis* CBS 6054, PDB1 | 66 | 67 |
| *Saccharomyces cerevisiae*, PDA1 | 68 | 69 |
| *Schizosaccharomycs pombe*, PDA1 | 70 | 71 |
| *Candida albicans*, PDA1 | 72 | 73 |
| *Kluyveromyces lactis*, PDA1 | 74 | 75 |
| *Yarrowia lipolytica*, PDA1 hypothetical protein | 76 | 77 |
| *Pichia stipitis*, PDA1 | 78 | 79 |
| *Saccharomyces cerevisiae* Lat1 pyruvate dehydrogenase complex | 729 | 730 |

TABLE 1-continued

SEQ ID NOs of target proteins and encoding sequences for reduction

| Organism and gene name | SEQ ID NO: nucleic acid | SEQ ID NO: amino acid |
|---|---|---|
| *Saccharomyces cerevisiae* Lpd1 pyruvate dehydrogenase complex | 731 | 732 |
| *Saccharomyces cerevisiae* Pdx1 pyruvate dehydrogenase complex | 733 | 734 |

TABLE 2

SEQ ID NOs of target proteins and encoding sequences for expression

| Organism, gene name and/or enzyme name | SEQ ID NO: nucleic acid | SEQ ID NO: amino acid |
|---|---|---|
| *Lactococcus lactis*, KivD (α-keto acid decarboxylase) | 123 | 124 |
| *Lactococcus lactis*, KdcA (α-keto acid decarboxylase) | 125 | 126 |
| *Staphylococcus epidermis* ATCC 12228, Pdc (indole-3-pyruvate decarboxylase) | 127 | 128 |
| *Bacillus cereus* ATCC 14579, Pdc (indole-3-pyruvate decarboxylase) | 129 | 130 |
| *Clostridium acetobutyricum* ATCC 824, Pdc (pyruvate decarboxylase) | 131 | 132 |
| *Pectobacterium atrosepticum* SCRI1043, Pdc (indole-3-pyruvate decarboxylase) | 133 | 134 |
| *Serratia proteamaculans* 568, Pdc (thiamine pyrophosphate binding domain-containing protein) | 135 | 136 |
| *Escherichia coli*, KARI (ketol-acid reductoisomerase) | 137 | 138 |
| *M maripaludis*, KARI (ketol-acid reductoisomerase) | 139 | 140 |
| *Bacillus subtilis*, KARI (ketol-acid reductoisomerase) | 141 | 142 |
| *Saccharomyces cerevisiae*, KARI (ketol-acid reductoisomerase) | 143 | 144 |
| *Vibrio cholerae*, KARI (ketol-acid reductoisomerase) | 145 | 146 |
| *Pseudomonas aeruginosa* PAO1, IlvC | 147 | 148 |
| *Pseudomonas fluorescens* PF5, IlvC | 149 | 150 |
| *Candida glabrata*, KARI | 151 | 152 |
| *Kluyveromyces lactis*, KARI | 153 | 154 |
| *Ashbya gossypii* ATCC 10895, KARI (ACL198Wp) | 155 | 156 |
| *Pichia stipitis* CBS 6054, KARI (mitochondrial ketol-acid reductoisomerase) | 157 | 158 |
| *Yarrowia lipolytica*, KARI | 159 | 160 |
| *Schizosaccharomyces pombe*, KARI (acetohydroxyacid reductoisomerase) | 161 | 162 |
| *Bacillus subtilis*, ALS (acetolactate synthase) | 689 | 690 |
| *Klebsiella pneumoniae*, ALS (acetolactate synthase) | 691 | 692 |
| *Lactococcus lactis*, ALS (acetolactate synthase) | 693 | 694 |
| *Staphylococcus aureus*, ALS (acetolactate synthase) | 695 | 696 |
| *Listeria monocyto* genes, ALS (acetolactate synthase) | 697 | 698 |
| *Streptococcus mutans*, ALS (acetolactate synthase) | 699 | 700 |
| *Streptococcus thermophilus*, ALS (acetolactate synthase) | 701 | 702 |
| *Vibrio angustum*, ALS (acetolactate synthase) | 703 | 704 |
| *Bacillus cereus*, ALS (acetolactate synthase) | 705 | 706 |

TABLE 2-continued

SEQ ID NOs of target proteins and encoding sequences for expression

| Organism, gene name and/or enzyme name | SEQ ID NO: nucleic acid | SEQ ID NO: amino acid |
|---|---|---|
| *Saccharomyces cerevisiae*, ALS (acetolactate synthase) | 727 | 728 |
| *Candida glabrata*, ALS (acetolactate synthase) | 707 | 708 |
| *Kluyveromyces lactis*, ALS (acetolactate synthase) | 709 | 710 |
| *Ashbya gossypii* ATCC 10895, ALS (acetolactate synthase) | 711 | 712 |
| *Pichia stipitis* CBS 6054, ALS (acetolactate synthase) | 713 | 714 |
| *Yarrowia lipolytica*, ALS (acetolactate synthase) | 715 | 716 |
| *Aspergillus nidulans* FGSC A4, ALS (acetolactate synthase) | 717 | 718 |
| *Saccharomyces cerevisiae*, POS5 (NADH kinase) | 719 | 720 |
| *Candida glabrata*, POS5 (NADH kinase) | 721 | 722 |
| *Kluveromyces lactis*, POS5 (NADH kinase) | 723 | 724 |
| *Pichia stipitis* CBS 6054, POS5 (NADH kinase) | 725 | 726 |

TABLE 3

SEQ ID NOs of representative bacterial [2Fe—2S] DHAD proteins and encoding sequences

| Organism of derivation | SEQ ID NO: nucleic acid | SEQ ID NO: amino acid |
|---|---|---|
| *Mycobacterium* sp. MCS | 163 | 164 |
| *Mycobacterium gilvum* PYR-GCK | 165 | 166 |
| *Mycobacterium smegmatis* str. MC2 155 | 167 | 168 |
| *Mycobacterium vanbaalenii* PYR-1 | 169 | 170 |
| *Nocardia farcinica* IFM 10152 | 171 | 172 |
| *Rhodococcus* sp. RHA1 | 173 | 174 |
| *Mycobacterium ulcerans* Agy99 | 175 | 176 |
| *Mycobacterium avium* subsp. *paratuberculosis* K-10 | 177 | 178 |
| *Mycobacterium tuberculosis* H37Ra | 179 | 180 |
| *Mycobacterium leprae* TN* | 181 | 182 |
| *Kineococcus radiotolerans* SRS30216 | 183 | 184 |
| *Janibacter* sp. HTCC2649 | 185 | 186 |
| *Nocardioides* sp. JS614 | 187 | 188 |
| *Renibacterium salmoninarum* ATCC 33209 | 189 | 190 |
| *Arthrobacter aurescens* TC1 | 191 | 192 |
| *Leifsonia xyli* subsp. *xyli* str. CTCB07 | 193 | 194 |
| *marine actinobacterium* PHSC20C1 | 195 | 196 |
| *Clavibacter michiganensis* subsp. *michiganensis* NCPPB 382 | 197 | 198 |
| *Saccharopolyspora erythraea* NRRL 2338 | 199 | 200 |
| *Acidothermus cellulolyticus* 11B | 201 | 202 |
| *Corynebacterium efficiens* YS-314 | 203 | 204 |
| *Brevibacterium linens* BL2 | 205 | 206 |
| *Tropheryma whipplei* TW08/27 | 207 | 208 |
| *Methylobacterium extorquens* PA1 | 209 | 210 |
| *Methylobacterium nodulans* ORS 2060 | 211 | 212 |
| *Rhodopseudomonas palustris* BisB5 | 213 | 214 |
| *Rhodopseudomonas palustris* BisB18 | 215 | 216 |
| *Bradyrhizobium* sp. ORS278 | 217 | 218 |
| *Bradyrhizobium japonicum* USDA 110 | 219 | 220 |
| *Fulvimarina pelagi* HTCC2506 | 221 | 222 |
| *Aurantimonas* sp. SI85-9A1 | 223 | 224 |
| *Hoeflea phototrophica* DFL-43 | 225 | 226 |
| *Mesorhizobium loti* MAFF303099 | 227 | 228 |
| *Mesorhizobium* sp. BNC1 | 229 | 230 |
| *Parvibaculum lavamentivorans* DS-1 | 231 | 232 |
| *Loktanella vestfoldensis* SKA53 | 233 | 234 |

TABLE 3-continued

SEQ ID NOs of representative bacterial [2Fe—2S] DHAD proteins and encoding sequences

| Organism of derivation | SEQ ID NO: nucleic acid | SEQ ID NO: amino acid |
|---|---|---|
| *Roseobacter* sp. CCS2 | 235 | 236 |
| *Dinoroseobacter shibae* DFL 12 | 237 | 238 |
| *Roseovarius nubinhibens* ISM | 239 | 240 |
| *Sagittula stellata* E-37 | 241 | 242 |
| *Roseobacter* sp. AzwK-3b | 243 | 244 |
| *Roseovarius* sp. TM1035 | 245 | 246 |
| *Oceanicola batsensis* HTCC2597 | 247 | 248 |
| *Oceanicola granulosus* HTCC2516 | 249 | 250 |
| *Rhodobacterales bacterium* HTCC2150 | 251 | 252 |
| *Paracoccus denitrificans* PD1222 | 253 | 254 |
| *Oceanibulbus indolifex* HEL-45 | 255 | 256 |
| *Sulfitobacter* sp. EE-36 | 257 | 258 |
| *Roseobacter denitrificans* OCh 114 | 259 | 260 |
| *Jannaschia* sp. CCS1 | 261 | 262 |
| *Caulobacter* sp. K31 | 263 | 264 |
| *Candidatus Pelagibacter ubique* HTCC1062 | 265 | 266 |
| *Erythrobacter litoralis* HTCC2594 | 267 | 268 |
| *Erythrobacter* sp. NAP1 | 269 | 270 |
| *Comamonas* testosterone KF-1 | 271 | 272 |
| *Sphingomonas wittichii* RW1 | 273 | 274 |
| *Burkholderia xenovorans* LB400 | 275 | 276 |
| *Burkholderia phytofirmans* PsJN | 277 | 278 |
| *Bordetella petrii* DSM 12804 | 279 | 280 |
| *Bordetella bronchiseptica* RB50 | 281 | 282 |
| *Bradyrhizobium* sp. ORS278 | 283 | 284 |
| *Bradyrhizobium* sp. BTAi1 | 285 | 286 |
| *Bradhyrhizobium japonicum* | 287 | 288 |
| *Sphingomonas wittichii* RW1 | 289 | 290 |
| *Rhodobacterales bacterium* HTCC2654 | 291 | 292 |
| *Solibacter usitatus* Ellin6076 | 293 | 294 |
| *Roseiflexus* sp. RS-1 | 295 | 296 |
| *Rubrobacter xylanophilus* DSM 9941 | 927 | 298 |
| *Salinispora tropica* CNB-440 | 299 | 300 |
| *Acidobacteria bacterium* Ellin345 | 301 | 302 |
| *Thermus thermophilus* HB27 | 303 | 304 |
| *Maricaulis maris* MCS10 | 305 | 306 |
| *Parvularcula bermudensis* HTCC2503 | 307 | 308 |
| *Oceanicaulis alexandrii* HTCC2633 | 309 | 310 |
| *Plesiocystis pacifica* SIR-1 | 311 | 312 |
| *Bacillus* sp. NRRL B-14911 | 313 | 314 |
| *Oceanobacillus iheyensis* HTE831 | 315 | 316 |
| *Staphylococcus saprophyticus* subsp. *saprophyticus* ATCC 15305 | 317 | 318 |
| *Bacillus selenitireducens* MLS10 | 319 | 320 |
| *Streptococcus pneumoniae* SP6-BS73 | 321 | 322 |
| *Streptococcus sanguinis* SK36 | 323 | 324 |
| *Streptococcus thermophilus* LMG 18311 | 325 | 326 |
| *Streptococcus suis* 89/1591 | 327 | 328 |
| *Streptococcus mutans* UA159 | 329 | 330 |
| *Leptospira borgpetersenii* serovar Hardjo-bovis L550 | 331 | 332 |
| *Candidatus Vesicomyosocius okutanii* HA | 333 | 334 |
| *Candidatus Ruthia magnifica* str. Cm (*Calyptogena magnifica*) | 335 | 336 |
| *Methylococcus capsulatus* str. Bath | 337 | 338 |
| uncultured marine bacterium EB80_02D08 | 339 | 340 |
| uncultured marine gamma proteobacterium EBAC31A08 | 341 | 342 |
| uncultured marine gamma proteobacterium EBAC20E09 | 343 | 344 |
| uncultured gamma proteobacterium eBACHOT4E07 | 345 | 346 |
| *Alcanivorax borkumensis* SK2 | 347 | 348 |
| *Chromohalobacter salexigens* DSM 3043 | 349 | 350 |
| *Marinobacter algicola* DG893 | 351 | 352 |
| *Marinobacter aquaeolei* VT8 | 353 | 354 |
| *Marinobacter* sp. ELB17 | 355 | 356 |
| *Pseudoalteromonas haloplanktis* TAC125 | 357 | 358 |
| *Acinetobacter* sp. ADP1 | 359 | 360 |
| *Opitutaceae bacterium* TAV2 | 361 | 362 |
| *Flavobacterium* sp. MED217 | 363 | 264 |
| *Cellulophaga* sp. MED134 | 365 | 366 |

TABLE 3-continued

SEQ ID NOs of representative bacterial [2Fe—2S] DHAD proteins and encoding sequences

| Organism of derivation | SEQ ID NO: nucleic acid | SEQ ID NO: amino acid |
|---|---|---|
| *Kordia algicida* OT-1 | 367 | 368 |
| *Flavobacteriales bacterium* ALC-1 | 369 | 370 |
| *Psychroflexus torquis* ATCC 700755 | 371 | 372 |
| *Flavobacteriales bacterium* HTCC2170 | 373 | 374 |
| unidentified eubacterium SCB49 | 375 | 376 |
| *Gramella forsetii* KT0803 | 377 | 378 |
| *Robiginitalea biformata* HTCC2501 | 379 | 380 |
| *Tenacibaculum* sp. MED152 | 381 | 382 |
| *Polaribacter irgensii* 23-P | 383 | 384 |
| *Pedobacter* sp. BAL39 | 385 | 386 |
| *Flavobacteria bacterium* BAL38 | 387 | 388 |
| *Flavobacterium psychrophilum* JIP02/86 | 389 | 390 |
| *Flavobacterium johnsoniae* UW101 | 391 | 392 |
| *Lactococcus lactis* subsp. *cremoris* SK11 | 393 | 394 |
| *Psychromonas ingrahamii* 37 | 395 | 396 |
| *Microscilla marina* ATCC 23134 | 397 | 398 |
| *Cytophaga hutchinsonii* ATCC 33406 | 399 | 400 |
| *Rhodopirellula baltica* SH 1 | 401 | 402 |
| *Blastopirellula marina* DSM 3645 | 403 | 404 |
| *Planctomyces maris* DSM 8797 | 405 | 406 |
| *Algoriphagus* sp. PR1 | 407 | 408 |
| Candidatus *Sulcia muelleri* str. Hc (*Homalodisca coagulata*) | 409 | 410 |
| *Candidatus Carsonella ruddii* PV | 411 | 412 |
| *Synechococcus* sp. RS9916 | 413 | 414 |
| *Synechococcus* sp. WH 7803 | 415 | 416 |
| *Synechococcus* sp. CC9311 | 417 | 418 |
| *Synechococcus* sp. CC9605 | 419 | 420 |
| *Synechococcus* sp. WH 8102 | 421 | 422 |
| *Synechococcus* sp. BL107 | 423 | 424 |
| *Synechococcus* sp. RCC307 | 425 | 426 |
| *Synechococcus* sp. RS9917 | 427 | 428 |
| *Synechococcus* sp. WH 5701 | 429 | 430 |
| *Prochlorococcus marinus* str. MIT 9313 | 431 | 432 |
| *Prochlorococcus marinus* str. NATL2A | 433 | 434 |
| *Prochlorococcus marinus* str. MIT 9215 | 435 | 436 |
| *Prochlorococcus marinus* str. AS9601 | 437 | 438 |
| *Prochlorococcus marinus* str. MIT 9515 | 439 | 440 |
| *Prochlorococcus marinus* subsp. *pastoris* str. CCMP1986 | 441 | 442 |
| *Prochlorococcus marinus* str. MIT 9211 | 443 | 444 |
| *Prochlorococcus marinus* subsp. *marinus* str. CCMP1375 | 445 | 446 |
| *Nodularia spumigena* CCY9414 | 447 | 448 |
| *Nostoc punctiforme* PCC 73102 | 449 | 450 |
| *Nostoc* sp. PCC 7120 | 451 | 452 |
| *Trichodesmium erythraeum* IMS101 | 453 | 454 |
| *Acaryochloris marina* MBIC11017 | 455 | 456 |
| *Lyngbya* sp. PCC 8106 | 457 | 458 |
| *Synechocystis* sp. PCC 6803 | 459 | 460 |
| *Cyanothece* sp. CCY0110 | 461 | 462 |
| *Thermosynechococcus elongatus* BP-1 | 463 | 464 |
| *Synechococcus* sp. JA-2-3B'a(2-13) | 465 | 466 |
| *Gloeobacter violaceus* PCC 7421 | 467 | 468 |
| *Nitrosomonas eutropha* C91 | 469 | 470 |
| *Nitrosomonas europaea* ATCC 19718 | 471 | 472 |
| *Nitrosospira multiformis* ATCC 25196 | 473 | 474 |
| *Chloroflexus aggregans* DSM 9485 | 475 | 476 |
| *Leptospirillum* sp. Group II UBA | 477 | 478 |
| *Leptospirillum* sp. Group II UBA | 479 | 480 |
| *Halorhodospira halophila* SL1 | 481 | 482 |
| *Nitrococcus mobilis* Nb-231 | 483 | 484 |
| *Alkalilimnicola ehrlichei* MLHE-1 | 485 | 486 |
| *Deinococcus geothermalis* DSM 11300 | 487 | 488 |
| *Polynucleobacter* sp. QLW-P1DMWA-1 | 489 | 490 |
| *Polynucleobacter necessarius* STIR1 | 491 | 492 |
| *Azoarcus* sp. EbN1 | 493 | 494 |
| *Burkholderia phymatum* STM815 | 495 | 496 |
| *Burkholderia xenovorans* LB400 | 497 | 498 |
| *Burkholderia multivorans* ATCC 17616 | 499 | 500 |
| *Burkholderia cenocepacia* PC184 | 501 | 502 |
| *Burkholderia mallei* GB8 horse 4 | 503 | 504 |

TABLE 3-continued

SEQ ID NOs of representative bacterial [2Fe—2S] DHAD proteins and encoding sequences

| Organism of derivation | SEQ ID NO: nucleic acid | SEQ ID NO: amino acid |
|---|---|---|
| *Ralstonia eutropha* JMP134 | 505 | 506 |
| *Ralstonia metallidurans* CH34 | 507 | 508 |
| *Ralstonia solanacearum* UW551 | 509 | 510 |
| *Ralstonia pickettii* 12J | 511 | 512 |
| *Limnobacter* sp. MED105 | 513 | 514 |
| *Herminiimonas arsenicoxydans* | 515 | 516 |
| *Bordetella parapertussis* | 517 | 518 |
| *Bordetella petrii* DSM 12804 | 519 | 520 |
| *Polaromonas* sp. JS666 | 521 | 522 |
| *Polaromonas naphthalenivorans* CJ2 | 523 | 524 |
| *Rhodoferax ferrireducens* T118 | 525 | 526 |
| *Verminephrobacter eiseniae* EF01-2 | 527 | 528 |
| *Acidovorax* sp. JS42 | 529 | 530 |
| *Delftia acidovorans* SPH-1 | 531 | 532 |
| *Methylibium petroleiphilum* PM1 | 533 | 534 |
| gamma proteobacterium KT 71 | 535 | 536 |
| *Tremblaya princeps* | 537 | 538 |
| *Blastopirellula marina* DSM 3645 | 539 | 540 |
| *Planctomyces maris* DSM 8797 | 541 | 542 |
| *Microcystis aeruginosa* PCC 7806 | 543 | 544 |
| *Salinibacter ruber* DSM 13855 | 545 | 546 |
| *Methylobacterium chloromethanicum* | 547 | 548 |

TABLE 4

SEQ ID NOs of representative fungal and plant [2Fe—2S] DHAD proteins and encoding sequences

| Description | SEQ ID NO: Nucleic acid | SEQ ID NO: Peptide |
|---|---|---|
| *Schizosaccharomyces pombe* ILV3 | 549 | 550 |
| *Saccharomyces cerevisiae* ILV3 | 551 | 552 |
| *Kluyveromyces lactis* ILV3 | 553 | 554 |
| *Candida albicans* SC5314 ILV3 | 555 | 556 |
| *Pichia stipitis* CBS 6054 ILV3 | 557 | 558 |
| *Yarrowia lipolytica* ILV3 | 559 | 560 |
| *Candida galbrata* CBS 138 ILV3 | 561 | 562 |
| *Chlamydomonas reinhardtii* | 563 | 564 |
| *Ostreococcus lucimarinus* CCE9901 | 565 | 566 |
| *Vitis vinifera* (CAO71581.1) | 567 | 568 |
| *Vitis vinifera* (CAN67446.1) | 569 | 570 |
| *Arabidopsis thaliana* | 571 | 572 |
| *Oryza sativa* (*indica* cultivar-group) | 573 | 574 |
| *Physcomitrella patens* subsp. *patens* | 575 | 576 |
| *Chaetomium globosum* CBS 148.51 | 577 | 578 |
| *Neurospora crassa* OR74A | 579 | 580 |
| *Magnaporthe grisea* 70-15 | 581 | 582 |
| *Gibberella zeae* PH-1 | 583 | 584 |
| *Aspergillus niger* | 585 | 586 |
| *Neosartorya fischeri* NRRL 181 (XP_001266525.1) | 587 | 588 |
| *Neosartorya fischeri* NRRL 181 (XP_001262996.1) | 589 | 590 |
| *Aspergillus niger* (An03g04520) | 591 | 592 |
| *Aspergillus niger* (An14g03280) | 593 | 594 |
| *Aspergillus terreus* NIH2624 | 595 | 596 |
| *Aspergillus clavatus* NRRL 1 | 597 | 598 |
| *Aspergillus nidulans* FGSC A4 | 599 | 600 |
| *Aspergillus oryzae* | 601 | 602 |
| *Ajellomyces capsulatus* NAm1 | 603 | 604 |
| *Coccidioides immitis* RS | 605 | 606 |

TABLE 4-continued

SEQ ID NOs of representative fungal and plant [2Fe—2S] DHAD proteins and encoding sequences

| Description | SEQ ID NO: Nucleic acid | SEQ ID NO: Peptide |
|---|---|---|
| *Botryotinia fuckeliana* B05.10 | 607 | 608 |
| *Phaeosphaeria nodorum* SN15 | 609 | 610 |
| *Pichia guilliermondii* ATCC 6260 | 611 | 612 |
| *Debaryomyces hansenii* CBS767 | 613 | 614 |
| *Lodderomyces elongisporus* NRRL YB-4239 | 615 | 616 |
| *Vanderwaltozyma polyspora* DSM 70294 | 617 | 618 |
| *Ashbya gossypii* ATCC 10895 | 619 | 620 |
| *Laccaria bicolor* S238N-H82 | 621 | 622 |
| *Coprinopsis cinerea okayama* 7#130 | 623 | 624 |
| *Cryptococcus neoformans* var. *neoformans* JEC21 | 625 | 626 |
| *Ustilago maydis* 521 | 627 | 628 |
| *Malassezia globosa CBS 7966* | 629 | 630 |
| *Aspergillus clavatus* NRRL 1 | 631 | 632 |
| *Neosartorya fischeri* NRRL 181 (Putative) | 633 | 634 |
| *Aspergillus oryzae* | 635 | 636 |
| *Aspergillus niger* (An18g04160) | 637 | 638 |
| *Aspergillus terreus* NIH2624 | 639 | 640 |
| *Coccidioides immitis* RS (CIMG_04591) | 641 | 642 |
| *Paracoccidioides brasiliensis* | 643 | 644 |
| *Phaeosphaeria nodorum* SN15 | 645 | 646 |
| *Gibberella zeae* PH-1 | 647 | 648 |
| *Neurospora crassa* OR74A | 649 | 650 |
| *Coprinopsis cinerea okayama* 7#130 | 651 | 652 |
| *Laccaria bicolor* S238N-H82 | 653 | 654 |
| *Ustilago maydis* 521 | 655 | 656 |

TABLE 5

SEQ ID NOs of representative [4Fe—4S] DHAD proteins and encoding sequences

| Organism | SEQ ID NO: nucleic acid | SEQ ID NO: amino acid |
|---|---|---|
| *Escherichia coli* str. K-12 substr. MG1655 | 657 | 658 |
| *Bacillus subtilis* subsp. *subtilis* str. 168 | 659 | 660 |
| *Agrobacterium tumefaciens* str. C58 | 661 | 662 |
| *Burkholderia cenocepacia* MC0-3 | 663 | 664 |
| *Psychrobacter cryohalolentis* K5 | 665 | 666 |
| *Psychromonas* sp. CNPT3 | 667 | 668 |
| *Deinococcus radiodurans* R1 | 669 | 670 |
| *Wolinella succinogenes* DSM 1740 | 671 | 672 |
| *Zymomonas mobilis* subsp. *mobilis* ZM4 | 673 | 674 |
| *Clostridium acetobutylicum* ATCC 824 | 675 | 676 |
| *Clostridium beijerinckii* NCIMB 8052 | 677 | 678 |
| *Pseudomonas fluorescens* Pf-5 | 679 | 680 |
| *Methanococcus maripaludis* C7 | 681 | 682 |
| *Methanococcus aeolicus* Nankai-3 | 683 | 684 |
| *Vibrio fischeri* ATCC 700601 (ES114) | 685 | 686 |
| *Shewanella oneidensis* MR-1 ATCC 700550 | 687 | 688 |

TABLE 6

| SEQ ID NOs of mitochondrial targeting signals and their encoding sequences | | |
|---|---|---|
| Organism and gene | SEQ ID NO: nucleic acid | SEQ ID NO: amino acid |
| *Saccharomyces cerevisiae*, cytochrome C oxidase (COX) subunit IV mitochondrial targeting sequence | 116 | 117 |
| *Saccharomyces cerevisiae*, mitochondrial targeting sequence (MTS) from the CDC9 DNA ligase gene | 119 | 120 |
| *Saccharomyces cerevisiae*, mitochondrial targeting sequence (MTS) from the ATP2 ATP synthase | 121 | 122 |

TABLE 7

| SEQ ID NOs of primers and vectors | | |
|---|---|---|
| Organism and gene name | Description | SEQ ID NO: nucleic acid |
| pRS423::FBAp (pNY13) | vector | 80 |
| ILV5-R(Xho) | primer | 81 |
| ILV5-F(XhoPstAsc) | primer | 82 |
| pRS426::GPM-kivD | vector | 83 |
| 112590-80A | primer | 84 |
| 112590-80D | primer | 85 |
| N133SeqR4 | primer | 86 |
| 112590-91A | primer | 87 |
| 112590-91B | primer | 88 |
| 112590-88A | primer | 89 |
| 112590-88B | primer | 90 |
| 112590-88C | primer | 91 |
| 112590-88D | primer | 92 |
| pUC19-URA3r | vector | 93 |
| 112590-97A | primer | 94 |
| 112590-97B | primer | 95 |
| 112590-49E | primer | 96 |
| 112590-97C | primer | 97 |
| 112590-108A | primer | 98 |
| 112590-108B | primer | 99 |
| 112590-108C | primer | 100 |
| 112590-108D | primer | 101 |
| 112590-108E | primer | 102 |
| 112590-108F | primer | 103 |
| BAT1 check | primer | 104 |
| 112590-118A | primer | 105 |
| 112590-118B | primer | 106 |
| pRS426::GAL1p-alsS | vector | 107 |
| 112590-118C | primer | 108 |
| 112590-118D | primer | 109 |
| 112590-118E | primer | 110 |
| 112590-118F | primer | 111 |
| 112590-118G | primer | 112 |

TABLE 14

| Pyruvate decarboxylase sequences | | |
|---|---|---|
| Organism and gene name | SEQ ID NO: nucleic acid | SEQ ID NO: amino acid |
| PDC1 pyruvate decarboxylase from *Saccharomyces cerevisiae* | 728 | 729 |
| PDC5 pyruvate decarboxylase from *Saccharomyces cerevisiae* | 730 | 731 |
| PDC6 pyruvate decarboxylase from *Saccharomyces cerevisiae* | 732 | 733 |
| pyruvate decarboxylase from *Candida glabrata* | 734 | 735 |
| PDC1 pyruvate decarboxylase from *Pichia stipitis* | 736 | 737 |
| PDC2 pyruvate decarboxylase from *Pichia stipitis* | 738 | 739 |
| pyruvate decarboxylase from *Kluyveromyces lactis* | 740 | 741 |
| pyruvate decarboxylase from *Yarrowia lipolytica* | 742 | 743 |
| pyruvate decarboxylase from *Schizosaccharomyces pombe* | 744 | 745 |

SEQ ID NO:113 is the nucleotide sequence of the GPM promoter from *Saccharomyces cerevisiae*.

SEQ ID NO:114 is the nucleotide sequence of the kivD coding region from *Lactococcus lactis* that was codon optimized for expression in *E. coli*.

SEQ ID NO: 115 is the nucleotide sequence of the ADH1 terminator from *Saccharomyces cerevisiae*.

SEQ ID NO: 118 is the nucleotide sequence of the coding region of ILV3 from *Kluyveromyces lactis* that was codon optimized for expression in *Saccharomyces cerevisiae*.

DETAILED DESCRIPTION OF THE INVENTION

Provided herein are recombinant yeast host cells having isobutanol production in the mitochondria. The disclosed yeast host cells may be used to produce isobutanol to provide an alternative to fossil fuels.

Provided herein are recombinant yeast cells engineered to have α-keto acid decarboxylase activity in the mitochondria in addition to having overexpressed ketol-acid reductoisomerase and dihydroxy-acid dehydratase activities in the mitochondria. These recombinant yeast cells have an isobutanol biosynthetic pathway in the mitochondria and produce isobutanol. The present recombinant yeast cells may have in addition overexpressed ATP-NAD (NADH) kinase activity in the mitochondria. The present recombinant yeast cells may have in addition reduced activity of threonine deaminase and isopropylmalate synthase in the mitochondria. Still further, the present recombinant yeast cells may have reduced pyruvate dehydrogenase activity in the mitochondria, and optionally reduced activity of branched chain amino acid transaminase in the mitochondria. These yeast cells produce increased amounts of isobutanol as compared to yeast cells without mitochondrial α-keto acid decarboxylase activity and with natural levels of the other enzyme activities stated above. Isobutanol is valuable as a fuel or fuel additive to reduce demand for fossil fuels.

The following abbreviations and definitions will be used for the interpretation of the specification and the claims.

As used herein, the terms “comprises,” “comprising,” “includes,” “including,” “has,” “having,” “contains” or “containing,” or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, “or” refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value The term "isobutanol biosynthetic pathway" refers to an enzyme pathway to produce isobutanol from pyruvate.

The term "carbon substrate" or "fermentable carbon substrate" refers to a carbon source capable of being metabolized by host organisms of the present invention.

The terms "acetohydroxy acid isomeroreductase" and "ketol-acid reductoisomerase" and "acetohydroxy acid reductoisomerase" may be used interchangeably and refer the enzyme having the EC number, EC 1.1.1.86 (*Enzyme Nomenclature* 1992, Academic Press, San Diego). Ketol-acid reductoisomerase (KARI) catalyzes the reaction of (S)-acetolactate to 2,3-dihydroxyisovalerate. These enzymes are available from a number of sources, including, but not limited to *E. coli* (DNA: SEQ ID NO:137; protein SEQ ID NO:138), *M. maripaludis* (DNA: SEQ ID NO:139; protein SEQ ID NO:140), *B. subtilis* (DNA: SEQ ID NO:141; protein SEQ ID NO:142), and *S. cerevisiae* (DNA: SEQ ID NO:143; protein SEQ ID NO:144). In yeast the gene encoding this enzyme is localized in the yeast nucleus however the encoded protein is transported to the mitochondria where it is metabolically active.

The term "α-keto acid decarboxylase" refers to an enzyme that catalyzes the conversion of α-ketoisovalerate to isobutyraldehyde (also called isobutanal) and $CO_2$. Alpha-keto acid decarboxylase enzymes, also called 2-oxoacid decarboxylases, are known by the EC number, EC 4.1.1.72. Examples include KivD (DNA SEQ ID NO:123; protein SEQ ID NO:124) and KdcA (DNA SEQ ID NO:125; protein SEQ ID NO:126), both from *Lactococcus lactis*. Pyruvate decarboxylases have the ability to use the α-ketoisovalerate substrate, but prefer pyruvate as a substrate. Engineering of any of these enzymes for higher conversion of the α-ketoisovalerate substrate would make them useful to the pathway described herein. In yeast the gene encoding this enzyme is localized in the yeast nucleus however the encoded protein is transported to the mitochondria where it is metabolically active.

The terms "acetolactate synthase" and "acetolactate synthetase" may be used intechangeably and refer to an enzyme that catalyzes the conversion of pyruvate to acetolactate and $CO_2$. Preferred acetolactate synthases are known by the EC number, EC 2.2.1.6 (*Enzyme Nomenclature* 1992, Academic Press, San Diego). These enzymes are available from a number of sources, including, but not limited to, *Bacillus subtilis* (DNA: SEQ ID NO:689; protein: SEQ ID NO:690), *Klebsiella pneumoniae* (DNA: SEQ ID NO:691; protein: SEQ ID NO:692), and *Lactococcus lactis* (DNA: SEQ ID NO:693; protein: SEQ ID NO:694). The gene encoding this enzyme is localized in the yeast nucleus however the encoded protein is transported to the mitochondria where it is metabolically active.

The term "acetohydroxy acid dehydratase" and "dihydroxy acid dehydratase" refer to an enzyme that catalyzes the conversion of 2,3-dihydroxyisovalerate to α-ketoisovalerate. Preferred dihydroxy acid dehydratases are known by the EC number 4.2.1.9. These enzymes are available from a vast array of microorganisms, including, but not limited to, *E. coli* (DNA SEQ ID NO:657, protein SEQ ID NO:658), *S. cerevisiae* (DNA SEQ ID NO:551, protein SEQ ID NO:552), *M. maripaludis* (DNA SEQ ID NO:681, protein SEQ ID NO:682), and *B. subtilis* (DNA SEQ ID NO:659, protein SEQ ID NO:660). The gene encoding this enzyme is localized in the yeast nucleus however the encoded protein is transported to the mitochondria where it is metabolically active.

The term "threonine deaminase refers to an enzyme having the EC number EC 4.3.1.19 (*Enzyme Nomenclature* 1992, Academic Press, San Diego). Threonine deaminase catalyzes the reaction of threonine to 2-oxobutanoate. This is an enzyme involved in branched chain amino acid biosynthesis, specifically of isoleucine. The gene encoding this enzyme is localized in the yeast nucleus however the encoded protein is transported to the mitochondria where it is metabolically active.

The term "isopropylmalate synthase" refers to an enzyme having the EC number, EC 2.3.3.13 (*Enzyme Nomenclature* 1992, Academic Press, San Diego). Isopropylmalate synthase catalyzes the reaction of alpha-ketoisovalerate to isopropyl malate. This is an enzyme involved in branched chain amino acid biosynthesis, specifically of leucine. The gene encoding this enzyme is localized in the yeast nucleus however the encoded protein is transported to the mitochondria where it is metabolically active.

The term "branched chain amino acid transaminase" refers to an enzyme having the EC number, EC 2.6.1.42 (*Enzyme Nomenclature* 1992, Academic Press, San Diego). Branched chain amino acid transaminase catalyzes the reaction of alpha-ketoisovalerate to valine. This is an enzyme involved in branched chain amino acid biosynthesis, specifically of valine. The gene encoding this enzyme is localized in the yeast nucleus however the encoded protein is transported to the mitochondria where it is metabolically active.

The term "NADH kinase" refers to an enzyme having the EC number, EC 2.7.1.86 (*Enzyme Nomenclature* 1992, Academic Press, San Diego). NADH kinase catalyzes the reaction of: ATP+NADH=ADP+NADPH. The gene encoding this enzyme is localized in the yeast nucleus however the encoded protein is transported to the mitochondria where it is metabolically active.

The term "pyruvate dehydrogenase" refers to an activity provided by a multienzyme complex that includes proteins PDA1, PDB1, LAT1, LPD1, and PDX1. PDA1 and PDB1 are E1α and E1β subunits of pyruvate dehydrogenase activity which has EC number EC 1.2.4.1. LAT1 is dihydrolipoyllysine-residue acetyltransferase, also called dihydrolopoyl transacetylase, which has EC number EC 2.3.1.12. LPD1 is dihydrolipoyl dehydrogenase which has EC number EC 1.8.1.4. Pyruvate dehydrogenase activity catalyzes the reaction of pyruvate to acetyl-CoA. The gene encoding this enzyme is localized in the yeast nucleus however the encoded protein is transported to the mitochondria where it is metabolically active.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. "Heterologous gene" includes a native coding region, or portion thereof, that is reintroduced into the source organism in a form that is different from the corresponding native gene. For example, a heterologous gene may include a native coding region that is a portion of a chimeric gene including non-native regulatory regions that is reintroduced into the native host. Also foreign genes can comprise native genes inserted into a non-native organism, or chimeric genes. A "transgene" is a gene that has been introduced into the genome by a transformation procedure.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

The term "overexpression", as used herein, refers to expression at a level that is above the expression level found in a cell prior to genetic manipulation.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

As used herein, an "isolated nucleic acid fragment" or "isolated nucleic acid molecule" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual,* 2$^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.,* 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular fungal proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: N.J. (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191(1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to about: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res*., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

Isobutanol Biosynthesis Pathway in Yeast Mitochondria

Disclosed herein are yeast cells with improved isobutanol production due to engineering of an isobutanol biosynthetic pathway in the mitochondria of yeast. This engineering may be performed in any type of yeast cell that is amenable to genetic engineering methods. Suitable yeasts include, but are not limited to, *Saccharomyces, Schizosaccharomyces, Hansenula, Candida, Kluyveromyces, Yarrowia* and *Pichia*. Suitable strains include, but are not limited to, *Saccharomyces cerevisiae Schizosaccharomyces pombe, Kluyveromyces lactis, Kluyveromyces thermotolerans, Candida glabrata, Candida albicans, Pichia stipitis* and *Yarrowia lipolytica.*

Applicants have found that by expressing α-keto acid decarboxylase activity in yeast mitochondria, along with increasing expression of endogenous enzymes in mitochondrial branched chain amino acid biosynthetic pathways, isobutanol is made in increased amounts from a mitochondrial isobutanol biosynthetic pathway. Applicants found that by introducing α-keto acid decarboxylase activity into the mitochondria and overexpressing mitochondrial ketol-acid reductoisomerase and dihydroxy-acid dehydratase activities, about a seven-fold increase in isobutanol production was achieved. Further a 13 fold increase in isobutanol production was achieved when these modifications were made in a yeast strain where mitochondrial threonine deaminase and isopropylmalate synthase activities had been eliminated. Additional reduction of pyruvate dehydrogenase and branched chain amino acid transaminase activities in the mitochondria resulted in over fifteen-fold increase in isobutanol production.

Mitochondrial biosynthetic pathways for natural branched chain amino acid biosynthesis, and for engineered isobutanol biosynthesis, are shown in the diagram in FIG. 1. The following enzymes are encoded by the genes labeled as steps (arrows) in the pathways in FIG. 1:

ILV1: threonine deaminase
ILV2: acetolactate synthase (ALS)
ILV3: dihydroxy-acid dehydratase (DHAD)
ILV5: acetohydroxy acid reductoisomerase, also called ketol-acid reductoisomerase (KARI)
KivD: α-keto acid decarboxylase
ADH: alcohol dehydrogenase
BAT1: branched chain amino acid aminotransferase
BAT2: branched chain amino acid transaminase
LEU4: isopropylmalate synthase
PDA1*: refers to the complex including the components:
PDA1: pyruvate dehydrogenase E1α subunit
PDB1: pyruvate dehydrogenase E1β subunit
LAT1: dihydrolipoyllysine-residue acetyltransferase
LPD1: dihydrolipoyl dehydrogenase
PDX1: protein X
POS5: mitochondrial NADH kinase Threonine deaminase, ALS, KARI, DHAD and BAT1 enzyme activities in the mitochondria form a biosynthetic pathway from threonine to isoleucine. ALS, KARI, DHAD and BAT1 enzyme activities in the mitochondria form a biosynthetic pathway from pyruvate to valine, with α-ketoisovalerate as an intermediate. Alpha-ketoisovalerate that is synthesized in yeast mitochondria is also transported to the cytosol where cytoplasmic branched chain amino acid transaminase (BAT2) activity converts it to valine. An isobutanol biosynthetic pathway that includes ALS, KARI, DHAD, KivD and alcohol dehydrogenase is disclosed in US Patent Publication #US20070092957 A1. To provide an isobutanol biosynthetic pathway using α-ketoisovalerate produced in the mitochondria, relying on endogenous alcohol dehydrogenase activity, applicants expressed KivD in either the cytosol or mitochondria in yeast with increased mitochondrial expression of KARI and DHAD. Applicants found that isobutanol production was more than doubled when KivD activity was present in the mitochondria as compared to being in the cytosol.

Endogenous alcohol dehydrogenase activity may be provided by any enzyme, and preferably by ADH1, ADH2, ADH3, ADH4, ADH5, ADH6, and ADH7. Endogenous alcohol dehydrogenase activity is provided in both the mitochondria and the cytosol since ADH3 is localized in the mitochondria while ADH1, ADH2, and ADH4-7 are in the cytosol. If desired for increased butanol production, ADH activity may be increased by increasing expression of any of these enzymes. Preferred is overexpression in both the cytosol and the mitochondria. Cytosolic enzymes may be targeted to the mitochondria as described below for α-keto acid decarboxylase. Chimeric genes, vectors, transformation and expression of these genes may be achieved as described below.

Mitochondrial Localized α-Ketoisovalerate Decarboxylase

In the present disclosure yeast cells are engineered to express α-keto acid decarboxylase activity that is localized in the mitochondria. The skilled person will appreciate that polypeptides having α-keto acid decarboxylase activity isolated from any source will be useful in the present invention. Some examples of suitable α-keto acid decarboxylase enzymes, as described in the definitions above, are KivD (DNA SEQ ID NO:123; protein SEQ ID NO:124) and KdcA (DNA SEQ ID NO:125; protein SEQ ID NO:126), both from *Lactococcus lactis*. Additional proteins that have at least about 40%-45%, 45%-50%, 50%-55%, 55%-60%, 60%-65%, 65%-70%, 70%-75%, 75%-80%, 80-85%, 85%-90%, 90%-95% or at least about 98% sequence identity to KivD or KdcA such as pyruvate decarboxylases from *Staphylococcus epidermidis* (DNA SEQ ID NO:127; protein SEQ ID NO:128), *Bacillus cereus* (DNA SEQ ID NO:129; protein SEQ ID NO:130), *Clostridium acetobutyricum* (DNA SEQ ID NO:131; protein SEQ ID NO:132), *Pectobacterium atrosepticum* (DNA SEQ ID NO:133; protein SEQ ID NO:134), and *Serratia proteamaculans* (DNA SEQ ID NO:135; protein SEQ ID NO:136), and that have α-keto acid decarboxylase activity, may be used in the present yeast cells. Typically BLAST (described above) searching of publicly available databases with known α-keto acid decarboxylase amino acid sequences, such as those provided herein, is used to identify additional α-keto acid decarboxylases, and their encoding sequences, that may be used in the present strains. Identities are based on the Clustal W method of alignment using the default parameters of GAP PENALTY=10, GAP LENGTH PENALTY=0.1, and Gonnet 250 series of protein weight matrix.

In addition to using protein or coding region sequence and bioinformatics methods to identify additional α-keto acid decarboxylases, the sequences described herein or those recited in the art may be used to experimentally identify other homologs in nature. For example each of the α-keto acid decarboxylase encoding nucleic acid fragments described herein may be used to isolate genes encoding homologous proteins. Isolation of homologous genes using sequence-dependent protocols is well known in the art. Examples of sequence-dependent protocols include, but are not limited to: 1.) methods of nucleic acid hybridization; 2.) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci. USA* 82:1074 (1985); or strand displacement amplification (SDA), Walker, et al., *Proc. Natl. Acad. Sci. U.S.A.,* 89:392 (1992)]; and 3.) methods of library construction and screening by complementation.

For example, genes encoding similar proteins or polypeptides to the α-keto acid decarboxylase encoding genes described herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of the described sequences may be used in polymerase chain reaction protocols to amplify longer nucleic acid fragments encoding homologous genes from DNA or RNA. The polymerase chain reaction may also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence may be based upon sequences derived from the cloning vector. For example, the skilled artisan can follow the RACE protocol (Frohman et al., *PNAS USA* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *PNAS USA* 86:5673 (1989); Loh et al., *Science* 243:217 (1989)).

Alternatively, the described α-keto acid decarboxylase encoding sequences may be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and will depend upon the specific test to be done. Typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness and Chen, *Nucl. Acids Res.* 19:5143-5151 (1991)). Suitable chaotropic agents include guanidinium chloride, guanidinium thiocyanate, sodium thiocyanate, lithium tetrachloroacetate, sodium perchlorate, rubidium tetrachloroacetate, potassium iodide and cesium trifluoroacetate, among others. Typically, the chaotropic agent will be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

For expression of α-keto acid decarboxylase, a coding region for an α-keto acid decarboxylase enzyme may be introduced into the mitochondrial genome as part of a chimeric gene for expression such that it is directly expressed in the mitochondrion. For yeast mitochondrial transformation DNA may be delivered to the mitochondrial matrix by high-velocity bombardment of yeast cells with tungsten microprojectiles carrying DNA for mitochondrial genome integration. Several high-velocity microprojectile bombardment devices are commercially available, and these are powered by gunpowder charge or compressed gas.

More typically, to obtain mitochondrial enzyme activity a mitochondrial targeting signal encoding sequence is operably linked to an α-keto acid decarboxylase coding region in a chimeric gene so that the expressed protein is translocated from the cytosol into the mitochondria. Any mitochondrial targeting signal sequence that is able to direct transport of a protein to the yeast mitochondrion may be used. Examples include mitochondrial targeting signal sequences that are present on proteins that are naturally transported to the mitochondrion in yeast such as KARI and DHAD. Some typically used mitochondrial targeting signals include those from *S. cerevisiae* cytochrome C oxidase (COX) subunit IV (coding region SEQ ID NO:116; amino acid SEQ ID NO:117; Hurt et al. EMBO J. (1984) 3(13):3149-56), *S. cerevisiae* CDC9 DNA ligase (coding region SEQ ID NO:119; amino acid SEQ ID NO:120: Donahue et al., (2001) *Nucleic Acids Res.* 29:1582-1589), and *S. cerevisiae* ATP2 ATP synthase (coding region SEQ ID NO:121; amino acid SEQ ID NO:122: Margeot et al, (2002) EMBO J. 21:6893-6904).

Expression of α-keto acid decarboxylase is achieved by transforming with a gene comprising a sequence encoding an α-keto acid decarboxylase protein. Methods for gene expression in yeasts are known in the art (see for example *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes encoding an α-keto acid decarboxylase, including, but not limited to constitutive promoters FBA, GPD, ADH1, and GPM, and the inducible promoters GAL1, GAL10, and CUP1. Suitable transcriptional terminators include, but are not limited to FBAt, GPDt, GPMt, ERG10t, GAL1t, CYC1, and ADH1.

Suitable promoters, transcriptional terminators, and α-keto acid decarboxylase coding regions may be cloned into *E. coli*-yeast shuttle vectors, and transformed into yeast cells as described in Examples 2-4. These vectors allow strain propagation in both *E. coli* and yeast strains. Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with a chimeric gene encoding an α-keto acid decarboxylase may be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Overexpression of α-Ketoisovalerate Substrate Production in the Mitochondria

In the present yeast cells expression of ketol-acid reductoisomerase and dihydroxy-acid dehydratase activities in the mitochondria is increased to increase mitochondrial biosynthesis of the α-ketoisovalerate substrate of the introduced mitochondrial α-keto acid decarboxylase activity disclosed above. Ketol-acid reductoisomerase (KARI) and dihydroxy-acid dehydratase (DHAD) are endogenous activities in yeast mitochondria. These enzyme activities may be overexpressed by engineering the cells for increased expression of the endogenous coding regions or by introducing genes for expression of heterologous coding regions for these enzymes. Genes for expression of KARI or DHAD may include sequences encoding mitochondrial targeting signals for translocation of the proteins from the cytosol to the mitochondria, or may be transformed into the yeast mitochondrial genome as described for mitochondrial α-keto acid decarboxylase expression.

Yeast KARI is encoded by an ILV5 gene. ILV5 encodes KARI and includes a mitochondrial targeting signal for translocation of the protein to the mitochondria. A KARI is endogenous or heterologous, depending on the type of yeast cell being engineered. For example, In *Saccharomyces cerevisiae*, the *S. cerevisiae* ILV5 coding region is endogenous while the *Kluveromyces lactis* ILV5 coding region is heterologous. Examples of KARI's that may be expressed either as endogenous or heterologous coding regions and proteins (depending on the host yeast cell) for overexpression of KARI activity in yeast mitochondria include, but are not limited to, those from ILV5 genes of *Saccharomyces cerevisiae* (DNA SEQ ID NO:143; protein SEQ ID NO:144), *Candida glabrata* (DNA SEQ ID NO151; protein SEQ ID NO:152), *Kluveromyces lactis* (DNA SEQ ID NO:153; protein SEQ ID NO:154), *Ashbya gossypii* (DNA SEQ ID NO:155; protein SEQ ID NO:156), *Pichia stipitis* (DNA SEQ ID NO:157; protein SEQ ID NO:158), *Yarrowia lipolytica* (DNA SEQ ID NO:159; protein SEQ ID NO:160), and *Schizosaccharomyces pombe* (DNA SEQ ID NO:161; protein SEQ ID NO:162).

In addition, bacterial KARIs may be expressed in the present yeast cells to overexpress KARI activity. When using a bacterial KARI a mitochondrial targeting signal is operably linked to the enzyme as described above for α-keto acid decarboxylase. KARI coding regions and proteins are listed in the definitions above. In addition, KARI enzymes with particularly high activities are disclosed in US Published Patent Application US20080261230. Examples of high activity KARIs disclosed therein are those from *Vibrio cholerae* (DNA: SEQ ID NO:15; protein SEQ ID NO:146), *Pseudomonas aeruginosa* PAO1, (DNA: SEQ ID NO:147; protein SEQ ID NO:148), and *Pseudomonas fluorescens* PF5 (DNA: SEQ ID NO:149; protein SEQ ID NO:150).

Other KARI proteins that may be used in the present yeast cells may be identified by one skilled in the art through bioinformatics methods as described above. Additional proteins that have at least about 40%-45%, 45%-50%, 50%-55%, 55%-60%, 60%-65%, 65%-70%, 70%-75%, 75%-80%, 80-85%, 85%-90%, 90%-95% or at least about 98% sequence identity to SEQ ID NOs:138, 140, 142, 144, or 146 and having ketol-acid reductoisomerase activity may be used. Identities are based on the Clustal W method of alignment using the default parameters of GAP PENALTY=10, GAP LENGTH PENALTY=0.1, and Gonnet 250 series of protein weight matrix. In addition, experimental methods as described above for identifying α-keto acid decarboxylase coding regions and proteins may be used to identify other KARI coding regions and proteins which may be used in the present yeast cells.

A yeast ILV5 KARI coding region may be expressed using its own promoter and terminator as in Example 1 herein, or it may be part of a chimeric gene using a heterologous promoter and/or terminator. A bacterial KARI coding region is expressed in a chimeric gene using a promoter and terminator active in yeast cells. Examples of promoters, terminators, and vectors for cloning and expression of genes in yeast, as well as introduction methods, are provided above in describing α-keto acid decarboxylase expression.

An alternative method for overexpressing endogenous KARI, or other endogenous gene described below, is to replace the natural transcription control elements. For example, the natural promoter may be replaced with a promoter that is more highly expressed. Endogenous gene chromosomal promoter replacement may be performed typically using homologous recombination methods, for example as described in Mnaimneh et al. ((2004) Cell 118(1):31-44).

Overexpression of DHAD in yeast mitochondria may be achieved using endogenous or heterologous DHAD. Yeast DHAD is encoded by an ILV3 gene. ILV3 encodes DHAD and includes a mitochondrial targeting signal for translocation of the protein to the mitochondria. Bacterial DHADs which may be used do not include a mitochondrial targeting signal. To express mitochondrial activity, either a mitochondrial targeting signal is operably linked to the enzyme or a gene comprising the bacterial DHAD coding region is transformed into the mitochondrial genome, as described above for α-keto acid decarboxylase expression.

Coding sequences for DHADs that may be used herein may be derived from bacterial, fungal, or plant sources.

DHADs that may be used may have a [4Fe-4S] 2+ cluster or a [2Fe-2S] 2+ cluster bound by the apoprotein. Tables 3, 4, and 5 list SEQ ID NOs for coding regions and proteins of representative DHADs that may be used in the present invention. Proteins with at least about 95% identity to those listed sequences have been omitted for simplification, but it is understood that the omitted proteins with at least about 95% sequence identity to any of the proteins listed in Tables 3, 4, and 5 and having DHAD activity may be used as disclosed herein. Additional DHAD proteins and their encoding sequences may be identified by BLAST searching of public databases, as well known to one skilled in the art. Typically BLAST (described above) searching of publicly available databases with known DHAD sequences, such as those provided herein, is used to identify DHADs and their encoding sequences that may be expressed in the present cells. For example, DHAD proteins having amino acid sequence identities of at least about 80-85%, 85%-90%, 90%-95% or 98% sequence identity to any of the DHAD proteins of Tables 3, 4, and 5 may be expressed in the present yeast cells. Identities are based on the Clustal W method of alignment using the default parameters of GAP PENALTY=10, GAP LENGTH PENALTY=0.1, and Gonnet 250 series of protein weight matrix over the full length of the protein sequence.

Additional [2Fe-2S] DHADs may be identified using the analysis described in U.S. Patent Application No. 61/100,792, which is herein incorporated by reference. Therein a Profile Hidden Markov Model (HMM) was prepared based on amino acid sequences of eight functionally verified DHADs. These DHADs are from *Nitrosomonas europaea* (DNA SEQ ID NO:471; protein SEQ ID NO:472), *Synechocystis* sp. PCC6803 (DNA SEQ ID:459; protein SEQ ID NO:460), *Streptococcus mutans* (DNA SEQ ID NO:329; protein SEQ ID NO:330), *Streptococcus thermophilus* (DNA SEQ ID NO:325; SEQ ID NO:326), *Ralstonia metallidurans* (DNA SEQ ID NO:507; protein SEQ ID NO:508), *Ralstonia eutropha* (DNA SEQ ID NO:343; protein SEQ ID NO:344), and *Lactococcus lactis* (DNA SEQ ID NO:505; protein SEQ ID NO:506). In addition the DHAD from *Flavobacterium johnsoniae* (DNA SEQ ID NO:391; protein SEQ ID NO:392) was found to have dihydroxy-acid dehydratase activity when expressed in *E. coli* and was used in making the Profile. The Profile HMM is prepared using the HMMER software package (The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences. The Profile HMM prepared for the eight DHAD proteins is given in Table 7. Any protein that matches the Profile HMM with an E value of $<10^{-5}$ is a DHAD related protein, which includes [4Fe-4S] DHADs, [2Fe-2S] DHADs, aldonic acid dehydratases, and phosphogluconate dehydratases. Sequences matching the Profile HMM are then analyzed for the presence of the three conserved cysteines, corresponding to positions 56, 129, and 201 in the *Streptococcus mutans* DHAD. The presence of all three conserved cysteines is characteristic of proteins having a [2Fe-2S] cluster. Proteins having the three conserved cysteines include arabonate dehydratases and [2Fe-2S] DHADs. The [2Fe-2S] DHADs may be distinguished from the aldonic acid dehydratases by analyzing for signature conserved amino acids found to be present in the [2Fe-2S] DHADs or in the aldonic acid dehydratases at positions corresponding to the following positions in the *Streptococcus mutans* DHAD amino acid sequence. These signature amino acids are in [2Fe-2S] DHADs or in aldonic acid dehydratases, respectively, at the following positions (with greater than 90% occurance): 88 asparagine vs glutamic acid; 113 not conserved vs glutamic acid; 142 arginine or asparagine vs not conserved; 165: not conserved vs glycine; 208 asparagine vs not conserved; 454 leucine vs not conserved; 477 phenylalanine or tyrosine vs not conserved; and 487 glycine vs not conserved.

Additionally, the sequences of DHAD coding regions provided herein may be used to identify other homologs experimentally as described above for α-keto acid decarboxylase.

Examples of promoters, terminators, and vectors for cloning and expression of genes in yeast, as well as introduction methods, are provided above in describing α-keto acid decarboxylase expression.

Acteolactate synthase (ALS) activity is also in the pathway for biosynthesis, from pyruvate, of the α-ketoisovalerate substrate of the introduced mitochondrial α-keto acid decarboxylase activity disclosed above. Though applicants found that overexpression in *S. cerevisiae* of the endogenous ILV2 gene encoding acetolactate synthase did not improve isobutanol production in the present yeast cells, expression of an alternate ALS in the yeast mitochondria may increase isobutanol production. Thus the present yeast cells may be engineered to express a heterologous ALS enzyme in the mitochondria. An ALS from a heterologous yeast may be expressed, which includes a mitochondrial targeting signal sequence. Examples that are heterologous when expressed in a yeast that is not the host of sequence origin include ALS from *Saccharomyces cerevisiae* (DNA SEQ ID NO:727; protein SEQ ID NO:728), *Candida glabrata* (DNA SEQ ID NO:707; protein SEQ ID NO:708), *Kluveromyces lactis* (DNA SEQ ID NO:709; protein SEQ ID NO:710), *Ashbya gossypii* (DNA SEQ ID NO:711; protein SEQ ID NO:712), *Pichia stipitis* (DNA SEQ ID NO:713; protein SEQ ID NO:714), *Yarrowia lipolytica* (DNA SEQ ID NO:715; protein SEQ ID NO:716), and *Aspergillus nidulans* (DNA SEQ ID NO:717; protein SEQ ID NO:718).

A bacteria ALS may be expressed as a heterologous ALS. To express mitochondrial ALS activity, either a mitochondrial targeting signal is operably linked to the enzyme or a gene comprising the bacterial ALS coding region is transformed into the mitochondrial genome, as described above for α-keto acid decarboxylase expression. Examples of bacterial ALS that may be used in the present yeast cells include those from *Bacillus subtilis* (DNA: SEQ ID NO:689; protein: SEQ ID NO:690), *Klebsiella pneumoniae* (DNA: SEQ ID NO:691; protein: SEQ ID NO:692), *Lactococcus lactis* (DNA: SEQ ID NO:693; protein: SEQ ID NO:694), *Staphylococcus aureus*, (DNA: SEQ ID NO:695; protein: SEQ ID NO:696), *Listeria monocytogenes* (DNA: SEQ ID NO:697; protein: SEQ ID NO:10 698), *Streptococcus mutans* (DNA: SEQ ID NO:699; protein: SEQ ID NO:700), *Streptococcus thermophilus* (DNA: SEQ ID NO:701; protein: SEQ ID NO:702), *Vibrio angustum* (DNA: SEQ ID NO:703; protein: SEQ ID NO:704), and *Bacillus cereus* (DNA: SEQ ID NO:705; protein: SEQ ID NO:706). Additional ALS coding regions and proteins may be identified using these sequences in bioinformatics or experimental methods as described above. ALS proteins with at least about 40%-45%, 45%-50%, 50%-55%, 55%-60%, 60%-65%, 65%-70%, 70%-75%, 75%-80%, 80-85%, 85%-90%, 90%-95% or at least about 98% sequence identity to the SEQ ID NOs above and having acetolactate synthase activity may be used. Identities are based on the Clustal W method of alignment using the default parameters of GAP PENALTY=10, GAP LENGTH PENALTY=0.1, and Gonnet 250 series of protein weight matrix.

Examples of promoters, terminators, and vectors for cloning and expression of genes in yeast, as well as introduction methods, are provided above in describing α-keto acid decarboxylase expression.

Over-Expressed Mitochondrial NADH Kinase

In the present yeast cells a mitochondrial NADH kinase may be over-expressed to improve isobutanol production. NADPH is required for activity of the KARI enzyme (see FIG. 1) which is in the pathway for production of the α-ketoisovalerate substrate of the introduced mitochondrial α-keto acid decarboxylase activity disclosed above. Increased mitochondrial NADH kinase activity provides increased NADPH availability to support increased KARI activity and increased α-ketoisovalerate substrate for the introduced mitochondrial α-keto acid decarboxylase.

In *S. cerevisiae* an NADH kinase that is localized to the mitochondrial matrix is encoded by the POS5 gene. Mitochondrial NADH kinase may be overexpressed by introducing a gene comprising the coding region of the POS5 gene or by replacing regulatory regions of the PO5 gene with higher expression regulatory regions as described above. An introduced gene comprising the coding region of the POS5 gene may include the natural regulatory regions or heterologous regulatory regions as described above. Examples of promoters, terminators, and vectors for cloning and expression of genes in yeast, as well as introduction methods, are provided above in describing α-keto acid decarboxylase expression.

Any coding region and protein with mitochondrial NADH kinase activity may be expressed in the present yeast cells. Examples include, but are not limited to, POS5 from *S. cerevisiae* (DNA SEQ ID NO:719; protein SEQ ID NO:720), *Candida glabrata* (DNA SEQ ID NO:721; protein SEQ ID NO:722), *Kluyveromyces lactis* (DNA SEQ ID NO:723; protein SEQ ID NO:724), and *Pichia stipitis* (DNA SEQ ID NO:725; protein SEQ ID NO:726). Other NADH kinase proteins that may be used in the present yeast cells may be identified by one skilled in the art through bioinformatics methods as described above. Additional proteins that have at least about 40%-45%, 45%-50%, 50%-55%, 55%-60%, 60%-65%, 65%-70%, 70%-75%, 75%-80%, 80-85%, 85%-90%, 90%-95% or at least about 98% sequence identity to SEQ ID NOsisted above, and having NADH kinase activity may be used. Identities are based on the Clustal W method of alignment using the default parameters of GAP PENALTY=10, GAP LENGTH PENALTY=0.1, and Gonnet 250 series of protein weight matrix. In addition, experimental methods as described above for identifying α-keto acid decarboxylase coding regions and proteins may be used to identify other NADH kinase coding regions and proteins which may be used in the present yeast cells.

Any coding regions expressed in the present yeast cells may be codon optimized for expression in the specific host yeast cell being engineered as is well known to one skilled in the art. For example, for expression of the *K. lactis* and *P. stipitis* ILV3 coding regions in *S. cerevisiae*, each was codon optimized for *S. cerevisiae* expression in Example 1 herein.

Yeast Cells with Reduced Competing Pathways for Mitochondrial Osobutanol Production Applicants have found that combining the engineering of yeast mitochondria for expression of genes as disclosed above with reducing expression of genes involved in mitochondrial branched chain amino acid biosynthesis and pyruvate metabolism gives improvement in isobutanol production.

In one embodiment the present yeast cells have one or more of these reductions in branched chain amino acid biosynthesis and pyruvate metabolism enzymes, as well as introduced mitochondrial α-keto acid decarboxylase activity, overexpressed ketol-acid reductoisomerase activity in the mitochondria, and overexpressed dihydroxy-acid dehydratase activity in the mitochondria as described above. Specifically, the present yeast cells may have reduced activity of threonine deaminase and reduced activity of isopropylmalate synthase in the mitochondria. Additionally the present yeast cells may have reduced pyruvate dehydrogenase activity in the mitochondria, and optionally reduced activity of branched chain amino acid transaminase in the mitochondria.

Eliminating threonine deaminase activity may affect pathway intermediate flow in the pathway from threonine to isoleucine. Eliminating isopropylmalate synthase activity may reduce metabolism of the α-ketoisovalerate intermediate in the leucine pathway. Eliminating mitochondrial branched chain amino acid aminotransferase activity may reduce metabolism of the alpha-ketoisovalerate intermediate in the valine pathway that is fully within the mitochondrion.

In the yeast mitochondria pyruvate is also converted to acetyl-CoA through pyruvate dehydrogenase activity (see FIG. 1). Applicants found that eliminating pyruvate dehydrogenase activity in the mitochondria further increased isobutanol production, suggesting that flow of pyruvate to alpha-ketoisovalerate was increased. The conversion of pyruvate to acetyl-CoA is catalyzed by a multienzyme pyruvate dehydrogenase complex. The pyruvate dehydrogenase enzyme is one enzyme of the multienzyme pyruvate dehydrogenase complex. Pyruvate dehydrogenase (EC 1.2.4.1) itself has alpha and beta subunits: PDA1 and PDB1, respectively, forming the E1α and E1β subunits, respectively, of the E1 component. The complex includes an E2 core which has dihydrolipoamide acetyltransferase activity (EC 2.3.1.12) and E3 which has dihydrolipoamide dehydrogenase activity (EC1.8.1.4). E2 may be encoded by LAT1 and E3 by LPD1. An additional complex protein is encoded by PDX1, which links Lat1p to Lpd1p. Thus the pyruvate dehydrogenase complex may include PDA1, PDB1, Lat1, Lpd1, and Pdx1, or homologous proteins encoded by genes which may have alternative names in various yeasts. The activity of any of these proteins may be reduced to affect the function of the pyruvate dehydrogenase complex, and thereby affect pyruvate dehydrogenase activity, to prepare a strain of one embodiment of the present invention. In the description below when referring to PDA1, it is understood that PDA1 may be substituted by any of PDB1, LAT1, LPD1, or PDX1, any of which may be modified to reduce pyruvate dehydrogenase activity.

In the present invention, any yeast enzymes providing threonine deaminase, isopropylmalate synthase, branched chain amino acid aminotransferase, or pyruvate dehydrogenase activities in the mitochondria may be targets for engineering to reduce these activities. Preferably the activity is reduced such that there is substantially no detectable activity of the target enzyme. Yeast cells are engineered to reduce enzyme activity typically by modification of the gene encoding the target enzyme. The genes encoding these enzymes are ILV1, LEU4, BAT1, and PDA1 (and miltienzyme complex genes PDB1, LAT1, LPD1, and PDX1), respectively. Any ILV1, LEU4, BAT1, or PDA1 gene of yeast encoding a mitochondrial targeted protein is a target for engineering for reduced expression of the encoded enzyme activity in the present cells. Examples of target coding region sequences and their encoded proteins from different species of yeast cells are given in Table 1. Other target proteins, or their encoding sequences, having at least about 70%-75%, 75%-80%, 80-85%, 85%-90%, 90%-95%, or at least about 98% sequence identity to any of the proteins or coding sequences listed in Table 1, and having one of these activities, may be identified in the literature and in bioinformatics databases well known to the skilled person.

There is cytoplasmic isopropylmalate synthase activity encoded by LEU9 and cytoplasmic branched chain amino acid transaminase activity encoded by BAT2, genes which are not targets in the present disclosure.

Because mitochondrial threonine deaminase, isopropylmalate synthase, branched chain amino acid aminotransferase, and pyruvate dehydrogenase complex enzymes are well known, as well as their encoding genes (ILV1, LEU4, BAT1, PDA1, PDB1, LAT1, LPD1, and PDX1, respectively), one skilled in the art can readily identify these proteins and their encoding genes in yeast cells using bioinformatics approaches, to identify additional target genes for engineering as disclosed herein. Typically BLAST (described above) searching of publicly available databases with known target protein sequences, such as those provided herein, is used to identify homologous proteins and their encoding sequences that may be targeted for inactivation in the present strains. For example, endogenous yeast mitochondrial threonine deaminase proteins having amino acid sequence identities of at least about 80-85%, 85%-90%, 90%-95% or 98% sequence identity to any of the threonine deaminase proteins of SEQ ID NOs:2, 3, 5, 7, 9, 11, or 13 may have reduced expression in the present strains. Identities are based on the Clustal W method of alignment using the default parameters of GAP PENALTY=10, GAP LENGTH PENALTY=0.1, and Gonnet 250 series of protein weight matrix.

In the following description, ILV1 is used as an example, and the same description applies to any of LEU4, BAT1, PDA1, PDB1, LAT1, LPD1, and PDX1 coding regions. The sequences of, for example, the ILV1 coding regions provided herein may be used to identify other homologs in nature. For example each of the threonine deaminase encoding nucleic acid fragments described herein may be used to isolate genes encoding homologous proteins. Isolation of homologous genes using sequence-dependent protocols is well known in the art. Examples of sequence-dependent protocols include, but are not limited to: 1.) methods of nucleic acid hybridization; 2.) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci*. USA 82:1074 (1985); or strand displacement amplification (SDA), Walker, et al., *Proc. Natl. Acad. Sci. U.S.A.,* 89:392 (1992)]; and 3.) methods of library construction and screening by complementation.

For example, genes encoding similar proteins or polypeptides to the threonine deaminase encoding genes provided herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.). Further description is presented above, exemplified for α-keto acid decarboxylases.

Threonine deaminase and isopropylmalate synthase, and optionally branched chain amino acid aminotransferase and/or pyruvate dehydrogenase activities may be reduced using genetic manipulations that disrupt expression of active enzyme from the target gene. Many methods for genetic modification of target genes are known to one skilled in the art and may be used to create the present yeast strains. Modifications that may be used to reduce or eliminate expression of a target protein are disruptions that include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed. In addition, expression of a gene may be blocked by expression of an antisense RNA or an interfering RNA, and constructs may be introduced that result in cosuppression. In addition, the synthesis or stability of the transcript may be lessened by mutation. Similarly the efficiency by which a protein is translated from mRNA may be modulated by mutation. In addition, since the target proteins are all mitochondrial, disruption of mitochondrial localization may be used such as disrupting the mitochondrial targeting signal sequence. All of these methods may be readily practiced by one skilled in the art making use of the known or identified coding sequences as exemplified in Table 1.

DNA sequences surrounding a target gene coding sequence are also useful in some modification procedures and are available for yeasts such as for *Saccharomycse cerevisiae* in the complete genome sequence coordinated by Genome Project ID9518 of Genome Projects coordinated by NCBI (National Center for Biotechnology Information) with identifying GOPID #13838. Additional examples of yeast genomic sequences include that of *Yarrowia lipolytica*, GOPIC #13837, and of *Candida albicans*, which is included in GPID #10771, #10701 and #16373. Additional genomes have been completely sequenced and annotated and are publicly available for the following yeast strains *Candida glabrata* CBS 138, *Kluyveromyces lactis* NRRL Y-1140, *Pichia stipitis* CBS 6054, and *Schizosaccharomyces pombe* 972h-.

In particular, DNA sequences surrounding a target coding sequence are useful for modification methods using homologous recombination. For example, in this method flanking sequences are placed bounding a selectable marker gene to mediate homologous recombination whereby the marker gene replaces the target gene. Also partial target gene sequences and flanking sequences bounding a selectable marker gene may be used to mediate homologous recombination whereby the marker gene replaces a portion of the target gene. In addition, the selectable marker may be bounded by site-specific recombination sites, so that following expression of the corresponding site-specific recombinase, the resistance gene is excised from the target gene without reactivating the latter. The site-specific recombination leaves behind a recombination site which disrupts expression of the target gene encoded protein. The homologous recombination vector may be constructed to also leave a deletion in the target gene following excision of the selectable marker, as is well known to one skilled in the art.

Deletions may be made using mitotic recombination as described in Wach et al. ((1994) Yeast 10:1793-1808). This method involves preparing a DNA fragment that contains a selectable marker between genomic regions that may be as short as 20 bp, and which bound a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in Methods in Enzymology, v194, pp 281-301 (1991)).

Moreover, promoter replacement methods may be used to exchange the endogenous transcriptional control elements allowing another means to modulate expression such as described in Mnaimneh et al. ((2004) Cell 118(1):31-44) and in Example 12 herein.

In addition, a target gene in any yeast cell may be disrupted using random mutagenesis, which is followed by screening to identify strains with reduced target gene encoded activity. Using this type of method, the DNA sequence of any region of the genome affecting expression of a target protein need not be known. Methods for creating genetic mutations are common and well known in the art and may be applied to the exercise of creating mutants. Commonly used random genetic modification methods (reviewed in *Methods in Yeast Genetics,* 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of yeast cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed in Spencer et al (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics,* 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al (Mutagenesis in Yeast, 1996, *Yeast Protocols: Methods in Cell and Molecular Biology*. Humana Press, Totowa, N.J.). Introduction of a mutator phenotype can also be used to generate random chromosomal mutations in yeast. Common mutator phenotypes can be obtained through disruption of one or more of the following genes: PMS1, MAG1, RAD18 or RAD51. Restoration of the non-mutator phenotype can be easily obtained by insertion of the wildtype allele. Collections of modified cells produced from any of these or other known random mutagenesis processes may be screened for reduced activity of the target enzyme.

Production of Isobutanol

Strains of yeast disclosed herein may be grown in fermentation media for production of isobutanol. Carbon substrates suitable for isobutanol production may include but are not limited to monosaccharides such as fructose, oligosaccharides such as lactose maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

Additionally the carbon substrate may also be one-carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., *Microb. Growth C1 Compd.*, [Int. Symp.], 7th (1993), 415-32, Editor(s): Murrell, J. Collin; Kelly, Don P. Publisher: Intercept, Andover, UK). Similarly, various species of Candida will metabolize alanine or oleic acid (Sulter et al., *Arch. Microbiol.* 153:485-489 (1990)). Hence it is contemplated that the source of carbon utilized in the present invention may encompass a wide variety of carbon containing substrates.

Although it is contemplated that all of the above mentioned carbon substrates and mixtures thereof are suitable in the present invention, preferred carbon substrates are glucose, fructose, and sucrose, or mixtures of these with C5 sugars such as xylose and/or arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Patent Application Publication No. 2007/0031918A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, fermentation media typically contains suitable minerals, salts, cofactors, buffers and other components, known to those skilled in the art, suitable for the growth of the cultures and promotion of the enzymatic pathway necessary for production of the desired product.

By-Product Formation

It will be appreciated that reduction and preferably elimination of by-products of carbon metabolism other than carbon dioxide and isobutanol would be advantageous for production of isobutanol. For example microorganisms metabolizing sugar substrates produce a variety of by-products in a mixed acid fermentation (Moat, A. G. et al., Microbial Physiology, 4th edition, John Wiley Publishers, N.Y., 2002). Yeast metabolizing sugar substrates produce a variety of by-products like acids and alcohols such as, but not limited to, formate, lactate, succinate, ethanol, acetate and glycerol. Formation of these byproducts during isobutanol fermentation lower the yield of isobutanol. To prevent yield loss of isobutanol the genes encoding enzyme activities corresponding to byproduct formation can be down-regulated or disrupted using methods described herein and/or known in the art.

Endogenous pyruvate decarboxylase activity in yeast converts pyruvate to acetaldehyde, which is then converted to ethanol or to acetyl-CoA via acetate. Therefore, endogenous pyruvate decarboxylase activity is a target for reduction of byproduct formation. Yeasts may have one or more genes encoding pyruvate decarboylase. For example, there is one gene encoding pyruvate decarboxylase in *Kluyveromyces lactis*, while there are three isozymes of pyruvate decarboxylase encoded by the PDC1, PCD5, and PDC6 genes in *Saccharomyces cerevisiae*, as well as a pyruvate decarboxylase regulatory gene PDC2. Expression of pyruvate decarboxylase from PDC6 is minimal. In yeast strains disclosed herein, the pyruvate decarboxylase activity may be reduced by down-regulating or disrupting at least one gene encoding a pyruvate decarboxylase, or a gene regulating pyruvate decarboxylase gene expression as described in U.S. patent application Ser. No. 12/477,942, which is herein incorporated by reference. For example, in *S. cerevisiae* the PDC1 and PDC5 genes, or all three genes, may be disrupted. Alternatively, pyruvate decarboxylase activity may be reduced by disrupting the PDC2 regulatory gene in *S. cerevisiae*. In other yeasts, genes encoding pyruvate decarboxylase proteins such as those having at least about 80-85%, 85%-90%, 90%-95%, or at least about 98% sequence identity to PDC1 or PDC5 may be down-regulated or disrupted. Examples of yeast pyruvate decarboxylase genes or proteins that may be targeted for down-regulation or disruption are listed in Table 14 (SEQ ID NOs: 728, 730, 732, 734, 736, 738, 740, 742, and 744).

Examples of yeast strains with reduced pyruvate decarboxylase activity due to disruption of pyruvate decarboxylase encoding genes have been reported such as for *Saccharomyces* in Flikweert et al. (Yeast (1996) 12:247-257), for *Kluyveromyces* in Bianchi et al. (Mol. Microbiol. (1996) 19(1):27-36), and disruption of the regulatory gene in Hohmann, (Mol Gen Genet. (1993) 241:657-666). *Saccharomyces* strains having no pyruvate decarboxylase activity are available from the ATCC (Accession #200027 and #200028).

Culture Conditions

Typically cells are grown at a temperature in the range of about 20° C. to about 37° C. in an appropriate medium. Suitable growth media in the present invention are common commercially prepared media such as broth that includes yeast nitrogen base, ammonium sulfate, and dextrose as the carbon/energy source) or YPD Medium, a blend of peptone, yeast extract, and dextrose in optimal proportions for growing most *Saccharomyces cerevisiae* strains. Other defined or synthetic growth media may also be used and the appropriate medium for growth of the particular microorganism will be known by one skilled in the art of microbiology or fermentation science.

Suitable pH ranges for the fermentation are between pH 3.0 to pH 7.5, where pH 4.5.0 to pH 6.5 is preferred as the initial condition.

Fermentations may be performed under aerobic or anaerobic conditions, where anaerobic or microaerobic conditions are preferred.

The amount of isobutanol produced in the fermentation medium can be determined using a number of methods known in the art, for example, high performance liquid chromatography (HPLC) or gas chromatography (GC).

Industrial Batch and Continuous Fermentations

The present process employs a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.,* 36:227, (1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention may be practiced using batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art. For example, solids may be removed from the fermentation medium by centrifugation, filtration, decantation, or the like. Then, the isobutanol may be isolated from the fermentation medium, which has been treated to remove solids as described above, using methods such as distillation, liquid-liquid extraction, or membrane-based separation. Because isobutanol forms a low boiling point, azeotropic mixture with water, distillation can only be used to separate the mixture up to its azeotropic composition. Distillation may be used in combination with another separation method to obtain separation around the azeotrope. Methods that may be used in combination with distillation to isolate and purify isobutanol include, but are not limited to, decantation, liquid-liquid extraction, adsorption, and membrane-based techniques. Additionally, isobutanol may be isolated using azeotropic distillation using an entrainer (see for example Doherty and Malone, *Conceptual Design of Distillation Systems*, McGraw Hill, New York, 2001).

The isobutanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol may also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the isobutanol from the solvent.

Distillation in combination with adsorption may also be used to isolate isobutanol from the fermentation medium. In this method, the fermentation broth containing the isobutanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, J., Fritsch, E. F. and Maniatis, T. *Molecular Cloning: A Laboratory Manual*; Cold Spring Harbor Laboratory Press: Cold Spring Harbor, N.Y. (1989) (Maniatis) and by T. J. Silhavy, M. L. Bennan, and L. W. Enquist, *Experiments with Gene Fusions*, Cold Spring Harbor Laboratory Press, Cold Spring Harbor, N.Y. (1984) and by Ausubel, F. M. et al., *Current Protocols in Molecular Biology*, pub. by Greene Publishing Assoc. and Wiley-Interscience (1987), and by *Methods in Yeast Genetics,* 2005, Cold Spring Harbor Laboratory Press, Cold Spring Harbor, N.Y.

Materials and methods suitable for the maintenance and growth of bacterial cultures are well known in the art. Techniques suitable for use in the following Examples may be found as set out in *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, eds), American Society for Microbiology, Washington, D.C. (1994)) or by Thomas D. Brock in *Biotechnology: A Textbook of Industrial Microbiology*, Second Edition, Sinauer Associates, Inc., Sunderland, Mass. (1989). All reagents, restriction enzymes and materials used for the growth and maintenance of microbial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.) unless otherwise specified. Microbial strains were obtained from The American Type Culture Collection (ATCC), Manassas, Va., unless otherwise noted. The oligonucleotide primers used in the following Examples are given in Table 3. All the oligonucleotide primers were synthesized by Sigma-Genosys (Woodlands, Tex.) or Integrated DNA Technologies (Coralsville, Iowa).

Synthetic complete medium is described in Amberg, Burke and Strathern, 2005, Methods in Yeast Genetics, Cold Spring Harbor Laboratory Press, Cold Spring Harbor, N.Y.

GC Method

The GC method utilized an HP-InnoWax column (30 m×0.32 mm ID, 0.25 μm film) from Agilent Technologies (Santa Clara, Calif.). The carrier gas was helium at a flow rate of 1 ml/min measured at 150° C. with constant head pressure; injector split was 1:10 at 200° C.; oven temperature was 45° C. for 1 min, 45° C. to 230° C. at 10° C./min, and 230° C. for 30 sec. FID detection was used at 260° C. with 40 ml/min helium makeup gas. Culture broth samples were filtered through 0.2 μM spin filters before injection. Depending on analytical sensitivity desired, either 0.1 μl or 0.5 μl injection volumes were used. Calibrated standard curves were generated for the following compounds: ethanol, isobutanol, acetoin, meso-2,3-butanediol, and (2S,3S)-2,3-butanediol. Analytical standards were also utilized to identify retention times for isobutryaldehyde, isobutyric acid, and isoamyl alcohol.

The meaning of abbreviations is as follows: "s" means second(s), "min" means minute(s), "h" means hour(s), "psi" means pounds per square inch, "nm" means nanometers, "d" means day(s), "μL" means microliter(s), "mL" means milliliter(s), "L" means liter(s), "mm" means millimeter(s), "nm" means nanometers, "mM" means millimolar, "M" means molar, "mmol" means millimole(s), "μmol" means micromole(s)", "g" means gram(s), "μg" means microgram(s) and "ng" means nanogram(s), "PCR" means polymerase chain reaction, "OD" means optical density, "$OD_{600}$" means the optical density measured at a wavelength of 600 nm, "kDa" means kilodaltons, "g" means the gravitation constant, "bp" means base pair(s), "kbp" means kilobase pair(s), "% w/v" means weight/volume percent, % v/v" means volume/volume percent, "wt %" means percent by weight, "HPLC" means high performance liquid chromatography, "GC" means gas chromatography, "FID" means flame ionization detector.

Example 1

Vector Construction for KARI and DHAD Expression

The purpose of this example is to demonstrate how to construct yeast expression vectors for expression of ketol acid reductoisomerase (KARI) and/or dihydroxy isovalerate dehydratase (DHAD) in the yeast mitochondria. KARI is encoded by the ILV5 gene and DHAD is encoded by the ILV3 gene. Both KARI and DHAD coding regions from yeast include sequences encoding mitochondrial targeting signals for localization of these proteins in the mitochondria.

Creation of DHAD Constructs:

pRS423::FBAp-ILV3(KL)-M(O).

To express the ILV3 gene from *Kluyveromyces lactis*, the coding region was codon-optimized for expression in *S. cerevisiae*, and a DNA fragment of this sequence was synthesized and cloned by DNA 2.0 (Menlo Park, Calif.). The synthesized ILV3 coding region fragment (SEQ ID NO:118) was isolated and cloned into the vector pRS423::FBAp (SEQ ID NO:80) with SphI and NotI. The pRS423::FBAp vector is also called pNY13. The pNY13 shuttle vector contained an F1 origin of replication (1423 to 1879) for maintenance in *E. coli* and a 2 micron origin (nt 7537 to 8881) for replication in yeast. The vector has an FBA promoter (nt 2111 to 3110) and FBA terminator (nt 4316 to 5315). In addition, it carries the HIS3 marker (nt 504 to 1163) for selection in yeast and ampicillin resistance marker (nt 6547 to 7404) for selection in *E. coli*. The resulting construct was named pRS423::FBAp-ILV3(KL).

pRS423::FBAp-ILV3(PS)-M(O).

To express the ILV3 gene from *Pichia stipitis*, the coding region was codon-optimized for expression in *S. cerevisiae* and a DNA fragment of this sequence was synthesized and cloned by DNA 2.0. The synthesized ILV3 coding region fragment was cloned into the same vector pRS423::FBAp (pNY13) described above with SphI and NotI. The resulting construct was named pRS423::FBAp-ILV3(PS)-M(O).

Creation of DHAD/KARI Constructs:

pRS423::FBAp-ILV3(KL)+nILV5

To combine the expression of ILV5 and ILV3 from *K. lactis* on a single vector, the native ILV5 gene from *S. cerevisiae*, including the promoter, coding region and terminator, was amplified from BY4741 (ATCC #201388) genomic DNA using Phusion DNA polymerase (New England Biolabs Inc., Beverly, Mass.; catalog no. F-540S) and primers ILV5-R (Xho) (SEQ ID NO:81) and ILV5-F(XhoPstAsc) (SEQ ID NO:82). The PCR product was digested with XhoI and AscI and ligated into the corresponding sites in the plasmid pRS423::FBAp-ILV3(KL)-M(O). The resulting construct was named pRS423 FBAp-ILV3(KL)+nILV5.

pRS423::FBAp-ILV3(PS)+nILV5

To combine the expression of ILV5 and ILV3 from *P. stipitis* on a single vector, the native ILV5 gene from *S. cerevisiae*, including the promoter, coding region and terminator, was amplified from BY4741 (ATCC #201388) genomic DNA using Phusion DNA polymerase (New England Biolabs Inc., Beverly, Mass.; catalog no. F-5405) and primers ILV5-R(Xho) (SEQ ID NO:81) and ILV5-F(XhoPstAsc) (SEQ ID NO:82). The PCR product was digested with XhoI and AscI and ligated into the corresponding sites in plasmid pRS423::FBAp-ILV3(PS)-M(O). The resulting construct was named pRS423 FBAp-ILV3(PS)+nILV5.

Example 2

Vector Construction for Expression of Alpha-Ketoisovalerate Decarboxylase and Acetolactate Synthase The purpose of this example is to demonstrate how to construct yeast expression vectors that express alpha-ketoisovalerate decarboxylase (KivD) and acetolactate synthase (ALS; ILV2 gene) in the yeast mitochondria. The ILV2 coding region from yeast includes a sequence encoding a mitochondrial targeting signal for localization of the protein in the mitochondria.

Creation of Mitochondria-Targeted KivD Constructs:

pRS426::GPM-kivD: Plasmid pRS426::FBA-ILV5-GPM-kivD was described in US Patent Publication US20070092957 A1, Example 17 which is herein incorporated by reference. Plasmid pRS426::FBA-ILV5-GPM-kivD is vector pRS426 (ATCC #77107) containing a chimeric gene including an FBA promoter, ILV5 coding region and CYC terminator, and a second chimeric gene containing a GPM promoter (SEQ ID NO:113), kivD coding region from *Lactococcus lactis* that was codon optimized for expression in *E. coli* (SEQ ID NO:114), and ADH1 terminator (SEQ ID NO:115). pRS426::FBA-ILV5-GPM-kivD was digested with SacII and NotI to remove the FBA-ILV5-CYC terminator gene. The remaining vector backbone was treated with T4 DNA polymerase to generate blunt ends, was ligated to reform a circularized product, and was transformed into *E. coli* Top10 cells. The resulting plasmid was named pRS426::GPM-kivD (SEQ ID NO:83).

pRS426::GPM-MTSkivD

In order to target the *Lactococcus lactis* KivD enzyme to the yeast mitochondria, the 25 amino acid mitochondrial targeting sequence from cytochrome C oxidase (COX) subunit IV of *S. cerevisiae* (DNA SEQ ID NO:116, protein SEQ ID NO:117; Hurt et al. EMBO J. (1984) 3(13):3149-56) was added to the N-terminus of KivD. This COX mitochondrial targeting sequence was added by PCR-amplification of kivD from pRS426::GPM-kivD using Phusion DNA polymerase (New England Biolabs Inc., Beverly, Mass.; catalog no. F-540S) and primers 112590-80A (SEQ ID NO:84) and 112590-80D (SEQ ID NO:85). The COX mitochondrial targeting sequence was present in primer 112590-80A. The PCR product was digested with BbvCI and AgeI, and ligated into BbvCI, AgeI, and CIP-digested pRS426-GPM-kivD. This digestion removed the N-terminal portion of the original kivD coding region, and replaced it with the mitochondrial targeting sequence fused to the N-terminal kivD sequence. The mitochondrial targeting sequence in the resulting plasmid, pRS426-GPM-MTSkivD was verified by DNA sequencing using primer N133SeqR4 (SEQ ID NO:86).

Creation of Acetolactate Synthase (ALS) Constructs

The native ILV2 locus, consisting of the promoter, coding region and terminator, was PCR-amplified from BY4743 genomic DNA using Phusion DNA polymerase (New England Biolabs Inc., Beverly, Mass.; catalog no. F-5405) with primers 112590-91A (SEQ ID NO:87) and 112590-91B (SEQ ID NO:88), which added 5' SacI 3' AvrII restriction sites. The PCR product was digested with SacI and AvrII, and ligated into pRS426-GPM-MTSkivD (described above) which was also digested with SacI and SpeI, then digested with CIP. The resulting plasmid, pRS426-nILV2-GPM-MTSkivD was verified by diagnostic restriction digestion and DNA sequencing using primers 112590-91A (SEQ ID NO:87) and 112590-91B (SEQ ID NO:88).

Example 3

Production of Isobutanol in Yeast Mitochondria

The purpose of this example is to demonstrate isobutanol production in the mitochondria of *S. cerevisiae* using the expression plasmids above that contain ILV3, ILV5, and either kivD or MTSkivD. Note that endogenous acetolactate activity from ILV2 is used in this example, as well as endogenous alcohol dehydrogenase activity.

Plasmids pRS423 containing the native ILV5 locus and FBAp-ILV3 cassette (*Pichia* or *Kluyveromyces*) and either pRS426 containing cytosolic kivD or MTSkivD were transformed into strain BY4741 using standard genetic techniques (*Methods in Yeast Genetics,* 2005, Cold Spring Harbor Laboratory Press, Cold Spring Harbor, N.Y.) and transformants were maintained on synthetic complete media lacking histidine and uracil, and supplemented with 2% glucose. The strains were grown in synthetic complete media lacking histidine and uracil and supplemented with 2% glucose under aerobic conditions (20 ml media in 125 ml flask) and cultured at 30° C. shaking at 220 rpm. Cultures were inoculated at 0.1 $OD_{600}$ and assayed for isobutanol titers at 48 hours post-inoculation. Isobutanol was quantitated by GC-FID on a HP-Innowax column using a standard curve of pure isobutanol and results are given in Table 9.

TABLE 9

Isobutanol production using cytoplasmic or mitochondrial KivD

| Strain | Isobutanol (mM) 48 hours |
|---|---|
| BY4741 pRS423/pRS426 | 0.07 |
| BY4741 pRS423-nILV5-FBAp-ILV3(KL)/pRS426 | 0.18 |
| BY4741 pRS423-nILV5-FBAp-ILV3(KL)/pRS426-GPMp-kivD | 0.22 |
| BY4741 pRS423-nILV5-FBAp-ILV3(KL)/pRS426-GPMp-MTSkivD | 0.53 |
| BY4741 pRS423-nILV5-FBAp-ILV3(PS)/pRS426 | 0.18 |
| BY4741 pRS423-nILV5-FBAp-ILV3(PS)/pRS426-GPMp-kivD | 0.20 |
| BY4741 pRS423-nILV5-FBAp-ILV3(PS) pRS426-GPMp-MTSkivD | 0.48 |

Expression of ILV5 and ILV3 in the yeast mitochondria increased the basal levels of isobutanol approximately 2-fold from the parent BY4741 strain. Expression of cytosolic KivD only marginally increased isobutanol titers. However, expression of mitochondrial-targeted KivD (MTSkivD) resulted in significant increases in isobutanol production, with only a small difference between *Pichia* and *Kluyveromyces* ILV3 enzymes.

Example 4

Production of Isobutanol in Yeast Mitochondria with Endogenous ALS Overexpression The purpose of this example is to demonstrate isobutanol production in the mitochondria of *S. cerevisiae* using the expression plasmids above that contain ILV3, ILV5, MTSkivD, and ILV2.

Plasmids pRS423-nILV5-FBAp-ILV3(KL) and pRS426-nILV2-GPMp-MTSkivD or pRS423-nILV5-FBAp-ILV3 (PS) and pRS426-nILV2-GPMp-MTSkivD (plasmids described above) were transformed into strain BY4741 using standard genetic techniques (*Methods in Yeast Genetics,* 2005, Cold Spring Harbor Laboratory Press, Cold Spring Harbor, N.Y.) and transformants were maintained on synthetic complete media lacking histidine and uracil, and supplemented with 2% glucose. Three to five colonies from each strain were grown in synthetic complete media lacking amino acid dropout mix but supplemented with methionine and leucine under aerobic conditions (20 ml media in 125 ml flask) and cultured at 30° C. shaking at 220 rpm. Cultures were inoculated at 0.1 $OD_{600}$ and assayed for isobutanol titers at 24 and 48 hours post-inoculation. Isobutanol was quantitated by GC-FID on a HP-Innowax column using a standard curve of pure isobutanol and results are given Table 10.

TABLE 10

Mitochondrial isobutanol production with overexpression of endogenous ALS

| Strain | Isobutanol (mM) 24 hours | Isobutanol (mM) 48 hours |
|---|---|---|
| BY4741 pRS423-nILV5-FBAp-ILV3(KL)/pRS426-nILV2-GPMp-MTSkivD | 0.171 ± 0.14 | 0.375 ± 0.08 |
| BY4741 pRS423-nILV5-FBAp-ILV3(PS)/pRS426-nILV2-GPMp-MTSkivD | 0.334 ± 0.04 | 0.385 ± 0.01 |

In this experiment addition of additional copies of the endogenous ALS gene (ILV2) did not improve isobutanol production.

Example 5

Eliminating Expression of Enzymes in Branched Chain Amino Acid Biosynthesis Pathways in *S. cerevisiae*

Yeast cells were engineered to eliminate activities of specific enzymes of mitochondrial branched chain amino acid biosynthesis. Three chromosomal disruptions were generated in successive fashion in the following genes: ILV1, encoding threonine deaminase; LEU4, encoding 2-isopropylmalate synthase; and BAT1, encoding branched chain amino acid aminotransferase.

An ilv1::LEU2 cassette was constructed by PCR amplification of the LEU2 marker from pRS425 (ATCC No. 77106) using Phusion DNA polymerase (New England Biolabs Inc., Beverly, Mass.; catalog no. F-540S) with primers 112590-88A (SEQ ID NO:89) and 112590-88B (SEQ ID NO:90). The ILV1 portion of each primer was derived from the 5' region upstream of the ILV1 promoter and 3' region downstream of the transcriptional terminator, respectively, such that integration of the LEU2 marker results in replacement of the ILV1 coding region. The ~1.7 kb PCR product was transformed into *Saccharomyces cerevisiae* strain BY4741 (ATCC #201388) with selection on synthetic complete media lacking leucine and supplemented with 2% glucose at 30° C. Transformants were screened by colony PCR using primers 112590-88C (SEQ ID NO:91) and 112590-88D (SEQ ID NO:92). The resulting identified strain had the genotype: BY4741 ilv1::LEU2.

A leu4::URA3r disruption cassette was constructed by PCR amplification of the URA3r marker from pUC19-URA3r (SEQ ID NO:93) using Phusion DNA polymerase (New England Biolabs Inc., Beverly, Mass.; catalog no. F-5405) and primers 112590-97A (SEQ ID NO:94) and 112590-97B (SEQ ID NO:95). pUC19-URA3r contains the URA3 marker from pRS426 (ATCC no. 77107) flanked by 75 bp homologous repeat sequences to allow homologous recombination in vivo and removal of the URA3 marker. The LEU4 portion of each primer was derived from the 5' region upstream of the LEU4 promoter and 3' region downstream of the transcriptional terminator, respectively, such that integration of the URA3r marker results in replacement of the LEU4 coding region. The ~1.5 kb PCR product was transformed into BY4741 ilv1::LEU2 cells with selection on synthetic complete media lacking uracil and supplemented with 2% glucose at 30° C. Transformants were screened by PCR using external primers 112590-49E (SEQ ID NO:96) and 112590-97C (SEQ ID NO:97) to verify integration at the correct site. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain had the genotype: BY4741 Δilv1 Δleu4.

A bat1::URA3r disruption cassette was constructed in several steps. A cassette containing the BAT1 5' region was amplified from BY4741 genomic DNA using Phusion DNA polymerase (New England Biolabs Inc., Beverly, Mass.; catalog no. F-5405) and primers 112590-108A (SEQ ID NO:98) and 112590-108B (SEQ ID NO:99). The cassette containing BAT1 3' sequences was amplified from BY4741 genomic DNA using Phusion DNA polymerase and primers 112590-108C (SEQ ID NO:100) and 112590-108D (SEQ ID NO:101). The URA3r marker was PCR-amplified from pUC19-URA3r using Phusion DNA polymerase and primers 112590-108E (SEQ ID NO:102) and 112590-108F (SEQ ID NO:103). The three PCR products were combined in a SOE PCR reaction (Horton et al. (1989) Gene 77:61-68) and amplified using Phusion DNA polymerase and the end primers 112590-108A (SEQ ID NO:98) and 112590-108D (SEQ ID NO:101), generating the full ~2.8 kb BAT1::URA3r disruption cassette. The BAT1 portion of each primer was derived from the 5' region upstream of the BAT1 promoter and 3' region downstream of the transcriptional terminator, respectively, such that integration of the URA3r marker results in replacement of the BAT1 coding region. The cassette was transformed into BY4741 Δilv1 Δleu4 with selection on synthetic complete media lacking uracil and supplemented with 2% glucose at 30° C. Transformants were screened by PCR using external primers 112590-49E (SEQ ID NO:96) and "BAT1 check" (SEQ ID NO:104) to verify integration at the correct site. The URA3r marker was recycled by plating on synthetic complete media supplemented with 2% glucose and 5-FOA at 30° C. following standard protocols. Marker removal was confirmed by patching colonies from the 5-FOA plates onto synthetic complete media lacking uracil supplemented with 2% glucose to verify the absence of growth. The resulting identified strain had the genotype: BY4741 Δilv1 Δleu4 Δbat1.

Example 6

Mitochondrial Isobutanol Production in Recombinant *S. cerevisiae* with Amino Acid Pathway Alterations Δilv1 Δleu4

The purpose of this example is to demonstrate isobutanol production in the mitochondria of *S. cerevisiae* in which expression of ILV1 (threonine deaminase) and LEU4 (2-isopropylmalate synthase) is disrupted.

Plasmids pRS423-nILV5-FBAp-ILV3(PS) and pRS426-nILV2-GPMp-MTSkivD, all described above, were transformed into strain BY4741 or strain BY4741 Δilv1 Δleu4 using standard genetic techniques (*Methods in Yeast Genetics,* 2005, Cold Spring Harbor Laboratory Press, Cold Spring Harbor, N.Y.) and transformants were maintained on synthetic complete media lacking histidine and uracil, and supplemented with 2% glucose. BY4741 Δilv1 Δleu4 was transformed with pRS423 and pRS426 as a control. Strains were grown in synthetic complete media lacking histidine and uracil, and supplemented with 2% glucose under aerobic conditions (20 ml media in 125 ml flask) and cultured at 30° C. shaking at 220 rpm. Cultures were inoculated at 0.1 $OD_{600}$ and assayed for isobutanol titers at 24 hours post-inoculation. Isobutanol was quantitated by GC-FID on a HP-Innowax column using a standard curve of pure isobutanol and results are given Table 11.

TABLE 11

Mitochondrial isobutanol production in 2-gene amino acid pathway modified strain

| Strain | Isobutanol (mM) 24 hours |
|---|---|
| BY4741 pRS423-nILV5-FBAp-ILV3(PS)/pRS426-nILV2-GPMp-MTSkivD | 0.334 ± 0.04* |
| BY4741 Δilv1 Δleu4 pRS423/pRS426 | 0.64 |
| BY4741 Δilv1 Δleu4 pRS423-nILV5-FBAp-ILV3(PS)/pRS426-nILV2-GPMp-MTSkivD | 0.95 |

*data from Example 4

Example 7

Mitochondrial Isobutanol Production in Recombinant *S. cerevisiae* Strain BY4741 Δilv1 Δleu4 Δbat1

The purpose of this example is to demonstrate isobutanol production in the mitochondria of *S. cerevisiae* in which ILV1 (threonine deaminase), LEU4 (2-isopropylmalate synthase), and BAT1 (branched-chain amino acid aminotransferase) are disrupted.

Plasmids pRS423::nILV5-FBAp-ILV3(PS) and pRS426::nILV2-GPMp-MTSkivD (plasmids described above) were transformed into strain BY4741 Δilv1 Δleu4 Δbat1 using standard genetic techniques (*Methods in Yeast Genetics,* 2005, Cold Spring Harbor Laboratory Press, Cold Spring Harbor, N.Y.) and transformants were maintained on synthetic complete media lacking histidine and uracil, and supplemented with 2% glucose. Strains were grown in synthetic complete media lacking histidine and uracil, and supplemented with 2% glucose under aerobic conditions (20 ml media in 125 ml flask) and cultured at 30° C. shaking at 220 rpm. Cultures were inoculated at 0.1 $OD_{600}$ and assayed for isobutanol titers at 24 hours post-inoculation. Isobutanol was quantitated by GC-FID on a HP-Innowax column using a standard curve of pure isobutanol and results are given Table 12.

TABLE 12

Mitochondrial isobutanol production in 3-gene amino acid pathway modified strain

| Strain | Isobutanol (mM) 24 hours |
|---|---|
| BY4741 Δilv1 Δleu4 Δbat1 pRS423/pRS426 | 0.90 |
| BY4741 Δilv1 Δleu4 Δbat1 pRS423::nILV5-FBAp-ILV3(PS)/ pRS426::nILV2-GPMp-MTSkivD Clone #1 | 0.91 |
| BY4741 Δilv1 Δleu4 Δbat1 pRS423::nILV5-FBAp-ILV3(PS)/ pRS426::nILV2-GPMp-MTSkivD Clone #2 | 0.53 |

Though there was variability in different clones, isobutanol production was similar in the triple disruption strain with and without mitochondrial expression of isobutanol pathway genes.

Example 8

Reduction of Pyruvate Dehydrogenase Activity in *S. cerevisiae*

To reduce levels of mitochondrial pyruvate dehydrogenase activity the PDA1 gene, encoding the E1α subunit of pyruvate dehydrogenase, was altered. The native promoter was replaced with the inducible GAL1 promoter through homologous recombination. The GAL1 promoter and URA3r marker were joined together by SOE PCR. The URA3r marker was PCR amplified from pUC19-URA3r using Phusion DNA polymerase (New England Biolabs Inc., Beverly, Mass.; catalog no. F-540S) and primers 112590-118A (SEQ ID NO:105) and 112590-118B (SEQ ID NO:106). The GAL1 promoter was PCR-amplified from pRS426::GAL1p-alsS (SEQ ID NO:107) using Phusion DNA polymerase (New England Biolabs Inc., Beverly, Mass.; catalog no. F-5405) and primers 112590-118C (SEQ ID NO:108) and 112590-118D (SEQ ID NO:109). pRS426::GAL1p-alsS contained an F1 origin of replication (nt 4976 to 5432) for maintenance in *E. coli* and a 2 micron origin (nt 2215 to 3560) for replication in yeast. The vector has a GAL1 promoter (nt 7702 to 8144) and CYC1 terminator (nt 5721 to 5970). In addition, it carries the URA3 marker (nt 4042 to 4845) for selection in yeast and ampicillin resistance marker (nt 1225 to 2082) for selection in *E. coli.*

The two products were joined by SOE PCR using Phusion DNA polymerase, and primers 112590-118E (SEQ ID NO:110) and 112590-118F (SEQ ID NO:111). The PDA1 portion of each primer was derived from the 5' region upstream of the PDA1 promoter and PDA1 coding sequence, respectively, such that integration of the URA3 marker results in replacement of the native PDA1 promoter with the GAL1 promoter. The PCR product was transformed into BY4741 Δilv1 Δleu4 Δbat1 with selection on synthetic complete media lacking uracil and supplemented with 2% glucose at 30° C. Transformants were screened by PCR using external primers 112590-49E (SEQ ID NO:96) and 112590-118G (SEQ ID NO:112) to verify integration at the PDA1 locus. The URA3r marker was recycled by plating on synthetic complete media supplemented with 2% glucose and 5-FOA at 30° C. following standard protocols. Marker removal was confirmed by patching colonies from the 5FOA plates onto synthetic complete media lacking uracil supplemented with 2% glucose to verify the absence of growth. The resulting identified strain had the genotype: BY4741 Δilv1 Δleu4 Δbat1 GAL1p-PDA1.

Example 9

Mitochondrial Isobutanol Production in Recombinant *S. cerevisiae* Strain BY4741 Δilv1 Δleu4 Δbat1 GAL1p-PDA1

The purpose of this example is to demonstrate isobutanol production in the mitochondria of *S. cerevisiae* in which ILV1 (threonine deaminase), LEU4 (2-isopropylmalate synthase), and BAT1 (branched-chain amino acid aminotransferase) were disrupted, and PDA1 (pyruvate dehydrogenase) was down-regulated.

Plasmids pRS423::nILV5-FBAp-ILV3(PS) and pRS426::GPMp-MTSkivD, described above, were transformed into strain BY4741 Δilv1 Δleu4 Δbat1 GAL1p-PDA1 using standard genetic techniques (*Methods in Yeast Genetics,* 2005, Cold Spring Harbor Laboratory Press, Cold Spring Harbor, N.Y.) and transformants were maintained on synthetic complete media lacking histidine and uracil, and supplemented with 2% glucose. Empty plasmid pRS423 and pRS426 were similarly transformed into BY4741 Δilv1 Δleu4 Δbat1 GAL1p-PDA as a control. Strains were grown in SD (2% glucose)-HIS-URA media under aerobic conditions (20 ml media in 125 ml flask) and were cultured at 30° C. shaking at 220 rpm. Under these growth conditions, the glucose present in the media repressed the GAL1 promoter thereby reducing expression of PDA1. Cultures were inoculated at 0.1 $OD_{600}$ and assayed for isobutanol titers at 24 hours post-inoculation. Isobutanol was quantitated by GC-FID on a HP-Innowax column using a standard curve of pure isobutanol and results are given Table 13.

TABLE 13

Mitochondrial isobutanol production in amino acid pathway and pyruvate metabolism modified strain

| Strain | Isobutanol (mM) 24 hours |
|---|---|
| BY4741 Δilv1 Δleu4 Δbat1 pRS423/pRS426 | 0.90 |
| BY4741 Δilv1 Δleu4 Δbat1 GAL1p-PDA1 pRS423/pRS426 | 0.95 |
| BY4741 Δilv1 Δleu4 Δbat1 GAL1p-PDA1 pRS423::nILV5-FBAp-ILV3(PS)/pRS426::GPMp-MTSkivD | 1.1 |

When the mitochondrial isobutanol pathway plasmids were introduced into the BY4741 Δilv1 Δleu4 Δbat1 GAL1p-PDA1 strain background, isobutanol titers increased significantly.

TABLE 8

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| | −538 | * | −1684 | | | | | | | | | | | | | | | | | | |
| 1(M) | −233 | −1296 | 99 | 1223 | −1477 | −1132 | 89 | −1122 | 420 | −1248 | 1757 | 1553 | −1296 | 464 | −24 | −190 | −188 | −838 | −1578 | −985 | 6 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | −538 | * | | | | | | | | | | | | |
| 2(E) | −220 | −1288 | 232 | 1356 | −1807 | 1016 | −70 | −1474 | 190 | −1584 | −775 | 132 | −1298 | 300 | −282 | −183 | 1140 | −1092 | −1872 | −1262 | 7 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | * | * | | | | | | | | | | | | |
| 3(K) | −448 | −1932 | 1558 | 658 | −2220 | −1048 | 40 | −1983 | 1569 | −1938 | −1091 | 1558 | −1319 | 450 | −193 | −278 | −419 | −1552 | −2121 | −1397 | 8 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | * | * | | | | | | | | | | | | |
| 4(V) | −404 | −498 | −1497 | −939 | −588 | −1810 | −640 | 1591 | 914 | −127 | 335 | −962 | −1866 | −562 | −767 | −868 | −357 | 1720 | −1169 | −763 | 9 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | * | * | | | | | | | | | | | | |
| 5(E) | −265 | −1340 | −52 | 1376 | −1572 | −1189 | 113 | −1125 | 1345 | −1287 | −496 | 99 | −1321 | 505 | 198 | −218 | −205 | 597 | −1598 | −1032 | 10 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | * | * | | | | | | | | | | | | |
| 6(S) | 256 | −397 | −1014 | −830 | −1841 | −646 | −862 | −1443 | −767 | −1740 | −963 | −568 | −1249 | −651 | −1007 | 2267 | 1586 | −862 | −2080 | −1672 | 11 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −29 | −6203 | −7245 | −894 | −1115 | −701 | −1378 | * | * | | | | | | | | | | | | |
| 7(M) | −990 | −889 | −2630 | 157 | −513 | −2514 | −1346 | 1309 | −1767 | 820 | 3683 | −1898 | −2491 | −1496 | −1799 | −1589 | −925 | 150 | −1336 | −1041 | 12 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 8(E) | 588 | −1875 | −194 | 1536 | −2188 | −1373 | −59 | −1931 | 957 | −1890 | −977 | 904 | 292 | 393 | −162 | 483 | −372 | −1495 | −2070 | −1391 | 13 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 9(N) | −514 | −1116 | 1207 | −315 | 447 | −1650 | −304 | −778 | −224 | 825 | −277 | 1457 | −1738 | −123 | −618 | −627 | −454 | −603 | −1186 | 763 | 14 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 10(N) | −815 | −1190 | −1360 | −922 | −904 | −1967 | −797 | −442 | −670 | 381 | 1700 | 3009 | −2099 | −654 | −934 | −1051 | −791 | −445 | −1490 | −979 | 15 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 11(K) | −1530 | −2498 | −1722 | −855 | −3141 | −2246 | −428 | −2627 | 2828 | −2404 | −1656 | −927 | 662 | −2 | 2047 | −1421 | −1337 | −2324 | −2357 | −2081 | 16 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 12(Y) | −872 | −1887 | −861 | −290 | −1369 | −1801 | 1662 | −1797 | 325 | −1793 | −1031 | 893 | −1876 | 56 | 2219 | −812 | −780 | −1514 | −1565 | 2287 | 17 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 13(S) | −830 | −1586 | −1471 | −1099 | −2717 | −1642 | −1010 | −2479 | −266 | −2518 | −1746 | −1065 | −2069 | −676 | 1822 | 2748 | −1000 | −1950 | −2597 | −2189 | 18 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 14(Q) | −851 | −2131 | −775 | −153 | −2554 | −1735 | −211 | −2205 | 1908 | −2094 | −1244 | −386 | −1802 | 2254 | 974 | 1001 | −747 | −1819 | −2181 | −1667 | 19 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 15(T) | −405 | −1258 | −618 | −100 | −1490 | −1466 | 1158 | −1121 | 1 | −1299 | −514 | 578 | −1607 | 65 | −433 | 960 | 1849 | 343 | −1677 | −1143 | 20 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 16(I) | −1772 | −1325 | −4307 | −3877 | −1405 | −3993 | −3383 | 2935 | −3705 | 820 | −217 | −3632 | −3761 | −3400 | −3682 | −3260 | −1742 | 2033 | −2838 | −2525 | 21 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 17(T) | −1018 | −1329 | −2004 | −1771 | −409 | −1993 | −1000 | −1256 | −1512 | −1464 | −966 | −1543 | −2367 | −1428 | −1638 | −1257 | 3050 | −1090 | −1012 | 2448 | 22 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 18(Q) | −1509 | −3056 | 1970 | 44 | −3310 | −1666 | −896 | −3242 | −877 | −3158 | −2439 | −322 | −2123 | 3562 | −1493 | −1259 | −1550 | −2779 | −3260 | −2446 | 23 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 19(D) | −1006 | −2199 | 2178 | −88 | −3159 | 1997 | −936 | −2974 | −948 | −2977 | −2174 | −382 | −1960 | −589 | −1571 | 1295 | −1157 | −2369 | −3178 | −2430 | 24 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 20(M) | 445 | −796 | −1082 | −521 | −841 | −1643 | −412 | −403 | −370 | −692 | 2213 | −646 | 536 | 1166 | −698 | −630 | 660 | 831 | −1204 | −767 | 25 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 21(Q) | 741 | −990 | −1025 | −507 | −1249 | −1551 | −519 | −720 | −357 | −1062 | −345 | −635 | −1739 | 1770 | −713 | −589 | 1576 | 1129 | −1559 | −1097 | 26 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 22(R) | −1753 | −2648 | −2072 | −1047 | −3365 | −2405 | −452 | −2782 | 1989 | −2495 | −1773 | −1062 | −2379 | 2402 | 2643 | −1629 | −1506 | −2504 | −2397 | −2190 | 27 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 23(S) | −330 | −1010 | −1820 | −1628 | −2778 | −1229 | −1652 | −2481 | −1592 | −2691 | −1841 | −1273 | 2130 | −1426 | −1834 | 2449 | 1034 | −1716 | −2961 | −2594 | 28 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 24(P) | 1882 | −1119 | −2231 | −2302 | −3062 | −1360 | −2209 | −2710 | −2339 | −3013 | −2243 | −1676 | 3304 | −2117 | −2409 | −742 | −918 | −1916 | −3263 | −3022 | 29 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 25(N) | 969 | −1230 | −1066 | −915 | −2593 | −1313 | −1196 | −2242 | −1033 | −2447 | −1626 | 3197 | −1850 | −898 | −1392 | −582 | 1155 | −1644 | −2736 | −2256 | 30 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 26(R) | −1847 | −2640 | −2014 | −1161 | −3282 | −2428 | −579 | −2818 | 687 | −2553 | −1869 | −1165 | −2462 | 2447 | 3181 | −1746 | −1630 | −2555 | −2447 | −2228 | 31 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 27(A) | 3048 | −932 | −2480 | −2533 | −3075 | −1200 | −2274 | −2765 | −2501 | −3071 | −2221 | −1658 | −1948 | −2205 | −2512 | 1225 | −739 | −1842 | −3322 | −3078 | 32 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 28(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 33 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 29(Y) | −1674 | −1506 | −2863 | −2464 | 596 | −2872 | 2251 | −972 | −2024 | 2197 | −552 | −1986 | −2876 | −1739 | −1988 | −1987 | −1601 | −1002 | −95 | 2332 | 34 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 30(Y) | −2013 | −2305 | −2428 | −1781 | −328 | −2709 | −654 | −2240 | −258 | −2064 | −1626 | −1631 | −2788 | −899 | 2789 | −2017 | −1896 | −2130 | −857 | 3434 | 35 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 31(A) | 2822 | −1031 | −2418 | −2539 | −3226 | 1898 | −2364 | −2941 | −2626 | −3229 | −2379 | −1722 | −2026 | −2302 | −2634 | −654 | −848 | −1983 | −3415 | −3226 | 36 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 32(I) | −1247 | −941 | −3569 | −3039 | −1082 | −3101 | −2185 | 2227 | −2763 | 766 | −76 | −2700 | −3050 | −2469 | −2697 | −2253 | 1322 | 1974 | −1988 | −1633 | 37 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 33(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 38 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 34(F) | −1511 | −1236 | −3511 | −3017 | 2747 | −2982 | −1069 | −260 | −2651 | 992 | 2737 | −2407 | −2904 | −2088 | −2418 | −2099 | −1434 | −489 | −537 | 2056 | 39 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 35(Q) | −576 | −1869 | −401 | 92 | −2232 | 831 | −173 | −1930 | 1505 | −1913 | −1042 | −186 | −1620 | 1653 | −51 | −482 | 1346 | −1534 | −2098 | −1490 | 40 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 36(D) | −1352 | −3066 | 3028 | 1349 | −3303 | −1566 | −724 | −3141 | 1155 | −3043 | −2267 | −165 | −1991 | −354 | −1350 | −1086 | −1368 | −2659 | −3221 | −2356 | 41 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 37(E) | −1507 | −3288 | 2042 | 2762 | −3520 | 515 | −853 | −3401 | −981 | −3296 | −2566 | −182 | −2064 | −503 | −1753 | −1209 | −1553 | −2895 | −3486 | −2547 | 42 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 38(D) | −1445 | −2778 | 3529 | −53 | −3524 | −1590 | −1129 | −3476 | −1367 | −3459 | −2774 | −396 | −2156 | −825 | −2122 | 554 | −1609 | −2880 | −3582 | −2717 | 43 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 39(F) | −2658 | −2176 | −4213 | −4000 | 3815 | −3933 | −1352 | −531 | −3638 | 1121 | −19 | −3184 | −3709 | −2820 | −3296 | −3219 | −2579 | −1037 | −601 | 403 | 44 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 40(D) | −684 | −2193 | 1738 | 1460 | −2494 | −1437 | −249 | −2257 | 1694 | −2199 | −1308 | −62 | −1637 | 185 | −450 | −531 | 633 | −1808 | −2374 | −1657 | 45 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 41(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 46 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 42(P) | 1882 | −1119 | −2231 | −2302 | −3062 | −1360 | −2209 | −2710 | −2339 | −3013 | −2243 | −1676 | 3304 | −2117 | −2409 | −742 | −918 | −1916 | −3263 | −3022 | 47 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 43(I) | −1006 | −992 | −2347 | −1784 | −650 | −2452 | −1256 | 2372 | −1386 | 77 | 2213 | −1720 | −2455 | 2030 | −1490 | −1528 | −946 | 106 | −1441 | −1111 | 48 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 44(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 49 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 45(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 50 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 46(I) | −1759 | −1303 | −4330 | −3968 | −1751 | −4051 | −3743 | 3027 | −3837 | −597 | −528 | −3729 | −3875 | −3688 | −3910 | −3369 | −1751 | 2438 | −3259 | −2819 | 51 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 47(V) | 1736 | −1012 | −3546 | −3078 | −1377 | −3073 | −2434 | 2052 | −2843 | −608 | −331 | −2754 | −3122 | −2619 | −2855 | −2270 | −1277 | 2193 | −2333 | −1941 | 52 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 48(N) | −686 | −1511 | −702 | −806 | −2927 | −1386 | −1339 | −2841 | −1264 | −2950 | −2137 | 2702 | −1979 | −1062 | −1648 | 2444 | −971 | −2105 | −3054 | −2475 | 53 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 49(M) | −411 | −857 | −1800 | −1434 | −1528 | 1914 | −1202 | −1029 | −1247 | −1347 | 2989 | −1217 | −1912 | −1119 | −1444 | −676 | 1550 | −767 | −1922 | −1539 | 54 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 50(W) | −782 | −1258 | 793 | −683 | 1193 | 346 | 2051 | −932 | −556 | −1092 | −441 | −798 | −1993 | −426 | −909 | −904 | −720 | −779 | 3163 | 1546 | 55 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 51(W) | 1009 | −798 | −1470 | −935 | −463 | −1773 | −545 | −460 | −751 | −736 | −66 | −943 | −1904 | −606 | −1002 | 1604 | −507 | −322 | 2535 | 1521 | 56 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 52(D) | −1137 | −2711 | 2125 | 1647 | −2995 | −1523 | −617 | −2786 | −528 | −2743 | −1933 | −150 | −1897 | −234 | −1165 | −924 | 2117 | −2331 | −2948 | −2141 | 57 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 53(I) | −599 | −1102 | −1031 | −829 | −1522 | 1429 | −927 | 2119 | −880 | −1369 | −699 | 1692 | −1938 | −759 | −1188 | −799 | −698 | −689 | −1887 | −1419 | 58 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 54(T) | −666 | −1412 | −954 | −984 | −2702 | −1428 | −1357 | −2418 | −1208 | −2650 | −1886 | 2293 | −2000 | −1101 | −1519 | −787 | 2967 | −1835 | −2866 | −2360 | 59 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 55(P) | −632 | −1230 | −2074 | −2144 | −2996 | −1453 | −2116 | −2631 | −2128 | −2928 | −2213 | −1658 | 3610 | −2006 | −2221 | −852 | 1302 | −1931 | −3185 | −2917 | 60 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 56(C) | −2476 | 5735 | −4102 | −4358 | −3712 | −2763 | −3545 | −3518 | −4167 | −3859 | −3569 | −3631 | −3363 | −4030 | −3832 | −2793 | −2860 | −3158 | −3464 | −3718 | 61 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 57(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 62 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 58(M) | 672 | −918 | −3119 | −2578 | −742 | −2668 | −1734 | 1807 | −2263 | 16 | 3713 | −2271 | −2704 | −1960 | −2216 | −1806 | −1058 | 493 | −1612 | −1306 | 63 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 59(H) | −1525 | −2164 | −1235 | −1346 | −2509 | 2296 | 4235 | −3172 | −1516 | −3178 | −2523 | −1448 | −2541 | −1520 | −1760 | −1591 | −1741 | −2656 | −2681 | −2065 | 64 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 60(L) | −2478 | −2009 | −4717 | −4196 | −568 | −4424 | −3262 | 1334 | −3887 | 2824 | 604 | −4085 | −3872 | −3088 | −3590 | −3717 | −2380 | −199 | −2217 | −2207 | 65 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 61(H) | −682 | −2191 | 1015 | 275 | −2485 | 396 | 2379 | −2251 | 62 | −2197 | −1307 | 1826 | −1636 | 1527 | −480 | −529 | −641 | −1803 | −2375 | −1654 | 66 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 62(D) | −575 | −1920 | 1979 | 184 | −2299 | 94 | −242 | −2029 | 114 | −2023 | −1144 | −120 | −1608 | 186 | 1063 | −469 | 1413 | −1605 | −2229 | −1561 | 67 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 63(L) | −2618 | −2139 | −4597 | −4163 | 2144 | −4285 | −2334 | −83 | −3854 | 2690 | 538 | −3771 | −3806 | −2950 | −3488 | −3563 | −2505 | −751 | −1442 | −808 | 68 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 64(A) | 2657 | −1033 | −2408 | −2532 | −3233 | 2193 | −2364 | −2950 | −2626 | −3237 | −2386 | −1719 | −2027 | −2301 | −2635 | −655 | −850 | −1988 | −3420 | −3231 | 69 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 65(K) | −443 | −1857 | 958 | 270 | −2158 | −1393 | −66 | −1890 | 1839 | −442 | −957 | −36 | −1499 | 1204 | −132 | 616 | −382 | −1469 | −2048 | −1383 | 70 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 66(C) | 605 | 1553 | 739 | −17 | −1374 | −1488 | −182 | 260 | 969 | −203 | −397 | −263 | −1573 | 159 | 691 | −426 | −331 | −761 | −1567 | −1032 | 71 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 67(A) | 2327 | −956 | −3193 | −2728 | −1289 | −2677 | −2114 | 1664 | −2485 | −601 | −288 | −2403 | −2839 | −2263 | −2523 | −1871 | −1126 | 1617 | −2143 | −1765 | 72 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 68(K) | −532 | −1656 | −490 | 1321 | −1891 | −1527 | −172 | −124 | 2206 | −1591 | −782 | −223 | −1619 | 237 | −106 | −482 | −464 | −98 | −1904 | −1326 | 73 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 69(H) | 384 | −1854 | 936 | 889 | −2165 | −1363 | 1498 | −1909 | 1111 | −1866 | −948 | 1091 | −1464 | 421 | −131 | −284 | −342 | −69 | −2043 | −1364 | 74 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 70(G) | 1823 | −932 | −2330 | −2313 | −3120 | 2511 | −2158 | −2865 | −2331 | −3098 | −2209 | −1563 | −1912 | −2032 | −2419 | 1138 | −706 | −1883 | −3328 | −3077 | 75 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 71(V) | −1760 | −1333 | −4244 | −3789 | −1262 | −3902 | −3190 | 1495 | −3588 | 1270 | −96 | −3536 | −3677 | −3238 | −3534 | −3148 | −1725 | 2865 | −2654 | −2373 | 76 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 72(W) | −1054 | −2172 | −1112 | −403 | −2566 | −1917 | −286 | −2196 | 2516 | −2095 | −1292 | 1183 | −1958 | 140 | 1333 | −959 | −922 | −1867 | 2591 | −1720 | 77 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 73(D) | 611 | −1995 | 1525 | 937 | −2295 | −1400 | −148 | −2043 | 211 | −2006 | −1106 | −37 | −1553 | 1420 | −312 | −408 | 1235 | −1609 | −2193 | −1499 | 78 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 74(A) | 2716 | −902 | −2380 | −2205 | −2799 | −1197 | −1975 | −2459 | −2081 | −2736 | −1895 | −1520 | −1895 | −1844 | −2201 | 1191 | 1299 | −1669 | −3045 | −2758 | 79 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 75(G) | −1709 | −2833 | 2424 | −409 | −3781 | 2819 | −1457 | −3777 | −1728 | −3733 | −3076 | −739 | −2389 | −1180 | −2441 | −1557 | −1893 | −3158 | −3660 | −3038 | 80 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −212 | −2909 | −8150 | −273 | −2534 | −701 | −1378 | * | * | | | | | | | | | | | | |
| 76(A) | 2529 | −1119 | −2614 | −2330 | −1245 | −1983 | −1829 | −377 | −2042 | 1435 | −341 | −1937 | −2411 | −1873 | −2088 | −1266 | −1059 | −397 | −2063 | −1713 | 82 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 77(W) | −472 | −361 | −2421 | −1812 | −298 | −1979 | −826 | 1164 | −1486 | −143 | 2485 | 873 | −2028 | −1185 | −1426 | −1048 | −412 | 1116 | 2999 | −454 | 83 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 78(P) | −1198 | −1737 | −2187 | −2394 | −3665 | 2006 | −2550 | −3630 | −2743 | −3756 | −3008 | −2052 | 3474 | −2495 | −2835 | −1401 | −1593 | −2736 | −3511 | −3519 | 84 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 79(Q) | −999 | −1075 | −2106 | −1568 | −726 | −2370 | −1175 | 83 | −1185 | 1373 | 218 | −1566 | −2400 | 2445 | −1340 | −1445 | −946 | 1441 | −1501 | −1146 | 85 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 80(Q) | −885 | −779 | −2609 | −2018 | −481 | −2414 | −1253 | 1645 | −1736 | 799 | 1924 | −1827 | −2405 | 2262 | −1752 | −1484 | −821 | 802 | −1240 | −935 | 86 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 81(F) | −3342 | −2776 | −4026 | −4232 | 4354 | −3545 | −1431 | −2315 | −4038 | −1801 | −1900 | −3299 | −3780 | −3350 | −3645 | −3490 | −3420 | −2566 | −739 | 349 | 87 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 82(G) | −998 | −2100 | −120 | −175 | −2567 | 2528 | 2174 | −2558 | −587 | −2583 | −1806 | 1422 | −1966 | −461 | −1038 | −925 | −1088 | −2095 | −2657 | −1948 | 88 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 83(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 89 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 84(I) | −1286 | −1279 | −2907 | −2683 | −1446 | −2549 | −2198 | 3290 | −2407 | −726 | −534 | −2386 | 1172 | −2299 | −2437 | −1895 | −1392 | 283 | −2302 | −1913 | 90 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 85(T) | −493 | −1105 | −2189 | −2267 | −3101 | 1880 | −2196 | −2791 | −2334 | −3081 | −2269 | −1649 | −2058 | −2099 | −2410 | −719 | 3135 | −1948 | −3282 | −3046 | 91 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 86(V) | −1750 | −1296 | −4319 | −3957 | −1765 | −4038 | −3733 | 2364 | −3826 | −619 | −543 | −3716 | −3869 | −3685 | −3902 | −3354 | −1743 | 3012 | −3265 | −2817 | 92 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 87(S) | 923 | −962 | −2348 | −2422 | −3132 | −1207 | −2248 | −2850 | −2440 | −3140 | −2285 | −1624 | −1954 | −2158 | −2477 | 3171 | −758 | −1896 | −3362 | −3103 | 93 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 88(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 94 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 89(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 95 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 90(I) | −1880 | −1493 | −4193 | −3724 | −953 | −3837 | −2980 | 3251 | −3420 | 257 | 2372 | −3485 | −3608 | −3005 | −3310 | −3087 | −1840 | 617 | −2373 | −2155 | 96 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 91(S) | 2150 | −939 | −2407 | −2415 | −3075 | −1197 | −2205 | −2781 | −2384 | −3065 | −2205 | −1613 | −1936 | −2105 | −2436 | 2652 | −729 | −1850 | −3306 | −3049 | 97 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 92(M) | −979 | −1455 | −1242 | −1122 | −1434 | −1860 | −1131 | −1171 | −974 | −1285 | 4091 | 2176 | −2226 | −1017 | −1187 | −1166 | −1086 | −1063 | −1929 | −1345 | 98 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 93(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 99 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 94(T) | −959 | −1691 | −1249 | −949 | −2563 | −1747 | −929 | −2093 | 1282 | −2263 | −1554 | −995 | −2115 | −600 | −354 | −1037 | 3152 | −1726 | −2494 | −2098 | 100 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 95(E) | −572 | −1860 | −208 | 2213 | −2107 | −1461 | −191 | −1808 | 199 | −116 | −983 | −127 | 318 | 1199 | −269 | −475 | −517 | −1448 | −2078 | −1441 | 101 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 96(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 102 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 97(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 103 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 98(R) | −2097 | −2786 | −2688 | −1415 | −3622 | −2625 | −555 | −2964 | 2585 | −2627 | −1957 | −1318 | −2577 | −137 | 3015 | −1979 | −1791 | −2732 | −2469 | −2363 | 104 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 99(Y) | −3615 | −2706 | −4169 | −4413 | 2626 | −4044 | −396 | −2535 | −3993 | −1939 | −1985 | −2747 | −3930 | −2852 | −3446 | −3296 | −3494 | −2686 | 347 | 4252 | 105 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 100(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 106 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 101(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 107 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 102(V) | −1381 | −1065 | −3714 | −3252 | −1453 | −3300 | −2646 | 1872 | −3023 | −615 | −373 | −2949 | −3287 | −2816 | −3039 | −2506 | 1346 | 2750 | −2489 | −2087 | 108 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 103(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 109 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 104(R) | −2957 | −3022 | −3318 | −2735 | −3796 | −2998 | −1968 | −3912 | −846 | −3631 | −3157 | −2611 | −3280 | −1724 | 4056 | −3026 | −2913 | −3650 | −3096 | −3185 | 110 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 105(E) | −1719 | −3572 | 2596 | 2779 | −3767 | −1632 | −993 | −3700 | −1241 | −3578 | −2920 | −234 | −2167 | −666 | −2090 | −1380 | −1789 | −3182 | −3742 | −2756 | 111 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 106(V) | −1746 | −1296 | −4308 | −3946 | −1757 | −4020 | −3712 | 2190 | −3811 | −614 | −539 | −3702 | −3858 | −3667 | −3884 | −3336 | −1740 | 3098 | −3250 | −2803 | 112 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 107(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 113 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 108(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 114 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 109(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 115 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 110(S) | −352 | 2942 | −2955 | −2957 | −2876 | −1254 | −2382 | −2573 | −2692 | −2927 | −2128 | −1827 | −2001 | −2405 | −2607 | 3103 | −778 | −1757 | −3171 | −2911 | 116 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 111(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 117 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 112(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 118 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 113(T) | 1556 | −936 | −2493 | −2457 | −2805 | −1256 | −2159 | −2210 | −2319 | −2681 | −1932 | −1656 | −1974 | −2089 | −2352 | −598 | 3235 | −1547 | −3111 | −2847 | 119 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 114(C) | 1784 | 2119 | −2013 | −1532 | −1093 | −1580 | −1089 | −436 | −1322 | −937 | −273 | 1093 | −1932 | −1127 | −1472 | −748 | −515 | 1585 | −1536 | −1163 | 120 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 115(M) | 1831 | 2019 | −2596 | −2038 | −605 | −1979 | −1126 | 244 | −1727 | −359 | 2501 | −1655 | −2145 | −1435 | −1683 | −1106 | −557 | 1087 | −1153 | −804 | 121 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 116(Q) | −987 | −2211 | −43 | −62 | −2833 | 2229 | −691 | −2616 | −407 | −2604 | −1797 | 1197 | −1917 | 2260 | −858 | −880 | −1045 | −2139 | −2772 | −2099 | 122 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 117(G) | 2313 | −1042 | −2391 | −2526 | −3250 | 2601 | −2372 | −2972 | −2637 | −3257 | −2407 | −1721 | −2032 | −2310 | −2646 | −662 | −859 | −2003 | −3434 | −3247 | 123 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 118(Q) | −914 | −2350 | −48 | 1661 | −2621 | −1571 | 2504 | −2400 | 68 | −2331 | −1486 | −201 | −1796 | 2646 | −351 | −754 | −865 | −1984 | −2463 | −1787 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 119(W) | −517 | −1294 | −733 | −183 | −1062 | −1605 | −234 | −1037 | 19 | −1207 | −456 | 1435 | −1690 | 33 | 756 | 411 | −454 | −819 | 3340 | 1286 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 120(M) | 410 | −469 | −2417 | −1828 | −341 | −2041 | −897 | 195 | −1513 | −156 | 3130 | −1534 | −2102 | −1230 | −1484 | −1117 | −507 | 954 | −894 | 2253 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 121(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 122(G) | 2142 | −930 | −2334 | −2298 | −3100 | 2237 | −2139 | −2842 | −2302 | −3074 | −2187 | −1557 | −1909 | −2010 | −2397 | 1136 | −701 | −1871 | −3308 | −3053 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 123(V) | −1514 | −1144 | −3950 | −3459 | 1821 | −3487 | −2577 | 2274 | −3208 | −209 | −87 | −3112 | −3362 | −2864 | −3118 | −2680 | −1476 | 2426 | −2194 | −1786 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 124(V) | −1743 | −1294 | −4292 | −3873 | −1511 | −3988 | −3433 | 2287 | −3712 | 598 | −319 | −3626 | −3774 | −3456 | −3716 | −3260 | −1717 | 2790 | −2931 | −2577 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 125(A) | 2911 | −954 | −2808 | −2665 | −2115 | −1577 | −2196 | −575 | −2445 | −1646 | −1202 | −1906 | −2208 | −2218 | −2451 | −901 | −876 | 1294 | −2727 | −2394 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 126(I) | −1764 | −1323 | −4298 | −3936 | −1668 | −3994 | −3655 | 3337 | −3783 | −508 | −462 | −3689 | −3838 | −3608 | −3835 | −3311 | −1759 | 1847 | −3164 | −2747 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 127(G) | −1157 | −1705 | −2169 | −2375 | −3654 | 3021 | −2534 | −3611 | −2730 | −3741 | −2984 | −2024 | 2418 | −2475 | −2826 | −1361 | −1555 | −2705 | −3513 | −3509 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 128(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 129(C) | −2476 | 5735 | −4102 | −4358 | −3712 | −2763 | −3545 | −3518 | −4167 | −3859 | −3569 | −3631 | −3363 | −4030 | −3832 | −2793 | −2860 | −3158 | −3464 | −3718 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 130(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 131(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 132(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 133(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 134(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 135(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 141 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 136(A) | 2180 | −935 | −2286 | −2196 | −3057 | 1098 | −2058 | −2796 | −2174 | −3021 | −2134 | −1516 | −1898 | −1906 | −2302 | 2146 | −689 | −1849 | −3256 | −2983 | 142 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 137(M) | −1799 | −1433 | −4142 | −3579 | −669 | −3668 | −2608 | 1558 | −3293 | 1235 | 3799 | −3296 | −3401 | −2717 | −3088 | −2843 | −1726 | 1156 | −2002 | −1868 | 143 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 138(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 144 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 139(A) | 3103 | −1036 | −2445 | −2572 | −3222 | 1051 | −2380 | −2930 | −2650 | −3226 | −2381 | −1739 | −2034 | −2327 | −2648 | −664 | −857 | −1981 | −3412 | −3228 | 145 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 140(M) | −2325 | −1891 | −4598 | −4012 | −498 | −4222 | −3013 | 1242 | −3722 | 1864 | 3929 | −3855 | −3711 | −2910 | −3414 | −3439 | −2215 | −299 | −2076 | −2098 | 146 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 141(A) | 3103 | −1036 | −2445 | −2572 | −3222 | 1051 | −2380 | −2930 | −2650 | −3226 | −2381 | −1739 | −2034 | −2327 | −2648 | −664 | −857 | −1981 | −3412 | −3228 | 147 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 142(R) | −1588 | −2442 | −1399 | −953 | −3069 | −2171 | −708 | −2795 | 373 | −2625 | −1916 | 1858 | −2357 | −324 | 3294 | −1520 | −1505 | −2453 | −2523 | −2186 | 148 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 143(M) | −1448 | −1256 | −3396 | −2819 | −474 | −3024 | −1923 | 175 | −2473 | 2225 | 2756 | −2574 | −2922 | −2063 | −2375 | −2153 | 952 | −151 | −1599 | −1410 | 149 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 144(N) | −1662 | −3306 | 2055 | 78 | −3621 | −1643 | −1040 | −3622 | −1272 | −3531 | −2870 | 3477 | −2182 | −724 | −2071 | −1371 | −1757 | −3092 | −3633 | −2700 | 150 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 145(I) | −1066 | −921 | −2828 | −2239 | −1041 | −2675 | −1601 | 2235 | −1668 | −455 | −92 | −2067 | −2692 | −1688 | 1701 | −1795 | −1024 | 1960 | −1771 | −1396 | 151 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 146(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 152 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 147(S) | 1568 | −940 | −2267 | −2192 | −3082 | 1101 | −2068 | −2826 | −2185 | −3049 | −2159 | −1515 | −1901 | −1915 | −2313 | 2603 | −694 | −1866 | −3279 | −3006 | 153 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 148(I) | −1880 | −1492 | −4195 | −3728 | −963 | −3841 | −2991 | 3272 | −3425 | 246 | 2277 | −3490 | −3613 | −3014 | −3317 | −3092 | −1841 | 628 | −2385 | −2163 | 154 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 149(F) | −2204 | −1797 | −3724 | −3473 | 3206 | −3383 | −628 | −1077 | −3092 | −746 | 3167 | −2502 | −3309 | −2372 | −2792 | −2535 | −2120 | −1245 | 28 | 2460 | 155 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 150(V) | 1265 | −1028 | −3200 | −2994 | −1833 | −2150 | −2480 | 417 | −2771 | −1122 | −818 | −2349 | −2640 | −2559 | −2766 | −1464 | −1118 | 3028 | −2700 | −2325 | 156 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 151(Y) | −3482 | −2868 | −3701 | −3919 | 238 | −3552 | −1112 | −3000 | −3638 | −2516 | −2526 | −3027 | −3772 | −3101 | −3341 | −3418 | −3527 | −3071 | −441 | 4711 | 157 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 152(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 158 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 153(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 159 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 154(T) | −359 | −976 | −2225 | −2229 | −2900 | −1242 | −2074 | −2560 | −2170 | −2875 | −2064 | −1561 | −1958 | −1969 | −2247 | 1110 | 3375 | −1760 | −3152 | −2850 | 160 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 155(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 161 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 156(H) | 861 | −1924 | −384 | 1010 | −2260 | −1477 | 1787 | −1974 | 1769 | −1918 | −1022 | −120 | −1566 | 362 | 697 | −417 | −459 | −1557 | −2073 | −1446 | 162 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 157(P) | −655 | −1502 | −711 | −557 | −2204 | −1463 | 2143 | −2122 | −586 | −2233 | −1445 | −688 | 2941 | −560 | −941 | 855 | −805 | −1657 | −2369 | −1763 | 163 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 158(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 164 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 159(H) | −744 | −2193 | −114 | 1118 | −2513 | −1512 | 2486 | −2252 | 1178 | −2183 | −1308 | 2230 | −1689 | 180 | −233 | −598 | −687 | −1823 | −2335 | −1670 | 165 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 160(W) | −2672 | −2139 | −3850 | −3748 | 941 | −3611 | −469 | −1691 | −3306 | 1047 | −1217 | −2551 | −3534 | −2514 | −2960 | −2788 | −2577 | −1799 | 4205 | 3466 | 166 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 161(K) | 386 | −1981 | 779 | 279 | −2295 | −1403 | −114 | −2043 | 2059 | −1991 | −1082 | 941 | −1536 | 1263 | −211 | −384 | −457 | −1602 | −2161 | −1476 | 167 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 162(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 168 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 163(K) | −1144 | −2365 | −912 | 2048 | −2856 | −1912 | −326 | −2459 | 2267 | −2295 | −1482 | −556 | −1989 | 108 | 1334 | −1013 | −1014 | −2093 | −2324 | −1881 | 169 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 164(D) | −1091 | −2610 | 2941 | 174 | −2957 | −1527 | −595 | −2750 | 1084 | −2696 | −1877 | −176 | −1885 | −206 | −1006 | 740 | −1098 | −2288 | −2880 | −2105 | 170 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 165(L) | −2387 | −1922 | −4674 | −4155 | −617 | −4366 | −3250 | 1889 | −3865 | 2650 | 558 | −4023 | −3847 | −3098 | −3586 | −3647 | −2296 | −38 | −2247 | −2224 | 171 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 166(N) | −1021 | −2427 | 1806 | 133 | −2870 | −1499 | −635 | −2647 | −521 | −2640 | −1825 | 2171 | −1874 | −255 | −1124 | −860 | 2122 | −2184 | −2853 | −2090 | 172 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 167(I) | −1830 | −1390 | −4327 | −3873 | −1210 | −3994 | −3274 | 2967 | −3678 | 1259 | −30 | −3633 | −3730 | −3283 | −3604 | −3249 | −1791 | 1570 | −2661 | −2417 | 173 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 168(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 174 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 169(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 175 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 170(A) | 2440 | −824 | −2371 | −2082 | −1993 | −1344 | −1704 | −1264 | −1899 | −1832 | −1137 | −1517 | −1946 | −1674 | −2005 | 1075 | −641 | 1474 | −2390 | −2055 | 176 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 171(F) | −3342 | −2776 | −4026 | −4232 | 4354 | −3545 | −1431 | −2315 | −4038 | −1801 | −1900 | −3299 | −3780 | −3350 | −3645 | −3490 | −3420 | −2566 | −739 | 349 | 177 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 172(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 178 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 173(A) | 2966 | −1031 | −2429 | −2551 | −3222 | 1544 | −2368 | −2934 | −2633 | −3225 | −2377 | −1727 | −2028 | −2309 | −2637 | −656 | −850 | −1980 | −3412 | −3224 | 179 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 174(V) | −1769 | −1342 | −4255 | −3793 | −1216 | −3901 | −3162 | 1633 | −3589 | 1486 | −51 | −3537 | −3667 | −3214 | −3518 | −3143 | −1731 | 2692 | −2609 | −2345 | 180 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 175(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 181 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 176(Q) | −729 | −2116 | −413 | 1096 | −2484 | −1587 | 1599 | −2186 | 1695 | −2094 | −1219 | −223 | −1698 | 2418 | 90 | −599 | −649 | −1770 | −2213 | −1615 | 182 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 177(W) | −1652 | −1707 | −2340 | −1879 | 1996 | −2733 | 2013 | −1398 | 1758 | −1386 | −938 | −1641 | −2751 | −1364 | −1762 | −1780 | −1577 | −1325 | 3577 | 2136 | 183 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 178(T) | −421 | −753 | −1251 | −704 | −846 | −1670 | −535 | 894 | −548 | −690 | −1 | 1376 | −1791 | −421 | −846 | 373 | 1461 | 858 | −1236 | −812 | 184 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 179(H) | 1498 | −1593 | −504 | 15 | −1895 | −1484 | 2279 | −1559 | 1119 | −1640 | −810 | −242 | −1611 | 194 | −171 | −462 | 815 | −1231 | −1914 | −1340 | 185 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 180(G) | −1515 | −2130 | −1298 | −1450 | −2658 | 3285 | 2212 | −3276 | −1691 | −3291 | −2638 | −1524 | −2562 | −1662 | −1925 | −1600 | −1764 | −2713 | −2804 | −2234 | 186 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 181(K) | −528 | −2010 | 1346 | 1082 | −2329 | −1408 | −118 | −2080 | 1475 | −2018 | −1108 | 1161 | −1543 | 331 | 1052 | −394 | −471 | −1632 | −2181 | −1494 | 187 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 182(M) | −1894 | −1521 | −4170 | −3679 | −840 | −3793 | −2866 | 2827 | −3360 | 375 | 3445 | −3437 | −3555 | −2902 | −3223 | −3028 | −1846 | 470 | −2249 | −2059 | 188 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 183(T) | −670 | −1758 | 1731 | −141 | −2591 | −1399 | −691 | −2319 | −499 | −2384 | −1543 | −387 | −1786 | −316 | −1016 | 1576 | 2044 | −1811 | −2624 | −1981 | 189 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 184(E) | 345 | −2074 | 925 | 1994 | −2378 | −1408 | −177 | −2135 | 922 | −2084 | −1183 | −38 | 641 | 264 | −356 | −444 | −536 | −1690 | −2261 | −1556 | 190 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 185(E) | −1493 | −2900 | 93 | 3174 | −2903 | −1743 | 1987 | −3042 | −646 | −2957 | −2238 | −411 | −2146 | −506 | −1121 | −1272 | −1503 | −2629 | −2905 | −2134 | 191 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 186(D) | −1293 | −2959 | 2673 | 2121 | −3219 | −1546 | −713 | −3043 | −707 | −2974 | −2191 | −158 | −1967 | −342 | −1394 | −1043 | 701 | −2567 | −3172 | −2311 | 192 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 187(F) | −1137 | −905 | −3250 | −2707 | 2365 | −2647 | −1016 | −34 | −2336 | 1239 | 267 | −2150 | −2626 | −1861 | −2133 | −1752 | −1069 | 1461 | −599 | 1844 | 193 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 188(K) | −479 | −1713 | −409 | 1031 | −1925 | −1467 | 1755 | −1650 | 1844 | −349 | −827 | −140 | −1556 | 319 | −75 | −403 | −411 | −1301 | −1900 | 843 | 194 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 189(G) | 433 | −2144 | 52 | 1047 | −2717 | 2303 | −615 | −2467 | −442 | −2482 | −1655 | 1123 | −1828 | −233 | −995 | −763 | −923 | −2000 | −2710 | −2005 | 195 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 190(V) | −1752 | −1320 | −4254 | −3806 | −1311 | −3916 | −3232 | 1701 | −3614 | 1188 | −140 | −3551 | −3693 | −3280 | −3568 | −3166 | −1718 | 2833 | −2703 | −2409 | 196 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 191(E) | −1199 | −1750 | −734 | 2668 | −1820 | −2038 | −1068 | 1892 | −867 | −1273 | −897 | −922 | −2295 | −797 | −1238 | −1340 | −1197 | −426 | −2325 | −1789 | 197 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 192(C) | −1182 | 3528 | −1398 | −620 | −2541 | −2038 | −358 | −2093 | 1181 | −2037 | −1272 | −747 | −2070 | 1553 | 2213 | −1123 | −1038 | −1817 | −2142 | −1774 | 198 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 193(N) | −1478 | −2527 | −261 | −403 | −2011 | −1837 | 2032 | −2925 | −735 | −2845 | −2195 | 3635 | −2259 | −721 | −1085 | −1352 | −1546 | −2522 | −2307 | −1431 | 199 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 194(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 200 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 195(C) | −1220 | 4911 | −3609 | −3314 | −1440 | −2525 | −2482 | 1565 | −2922 | −706 | −544 | −2678 | −2896 | −2710 | −2836 | −1869 | −1375 | 379 | −2371 | −1957 | 201 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 196(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 202 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 197(G) | −477 | −1115 | −1983 | −2189 | −3315 | 3154 | −2272 | −3172 | −2506 | −3387 | −2522 | −1599 | −2042 | −2177 | −2583 | 1217 | −905 | −2130 | −3477 | −3225 | 203 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 198(A) | 1653 | −1347 | −705 | −249 | −1969 | −1385 | −477 | −1629 | −159 | −1759 | −935 | −434 | 1285 | 1404 | −586 | −450 | 1019 | −1243 | −2070 | −1522 | 204 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 199(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 205 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 200(S) | 1870 | −938 | −2270 | −2183 | −3068 | 1488 | −2056 | −2810 | −2168 | −3032 | −2144 | −1511 | −1898 | −1901 | −2300 | 2236 | −690 | −1857 | −3265 | −2990 | 206 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 201(C) | −2476 | 5735 | −4102 | −4358 | −3712 | −2763 | −3545 | −3518 | −4167 | −3859 | −3569 | −3631 | −3363 | −4030 | −3832 | −2793 | −2860 | −3158 | −3464 | −3718 | 207 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 202(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 208 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 203(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 209 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 204(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 210 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 205(Y) | −3590 | −2700 | −4146 | −4379 | 2092 | −4028 | −404 | −2517 | −3963 | −1928 | −1973 | −2744 | −3921 | −2845 | −3431 | −3284 | −3474 | −2669 | 336 | 4423 | 211 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 206(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 212 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 207(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 213 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 208(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 214 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 209(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 215 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 210(M) | −2355 | −1988 | −4343 | −3834 | −504 | −4051 | −2868 | 105 | −3385 | 1451 | 4460 | −3680 | −3671 | −2806 | −3171 | −3327 | −2274 | −474 | −2039 | −1925 | 216 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 211(S) | 2150 | −939 | −2407 | −2415 | −3075 | −1197 | −2205 | −2781 | −2384 | −3065 | −2205 | −1613 | −1936 | −2105 | −2436 | 2652 | −729 | −1850 | −3306 | −3049 | 217 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 212(S) | −344 | −979 | −2190 | −2162 | −2959 | −1227 | −2042 | −2651 | −2116 | −2934 | −2100 | −1526 | −1941 | −1909 | −2222 | 2940 | 1775 | −1804 | −3187 | −2882 | 218 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 213(A) | 3048 | −932 | −2480 | −2533 | −3075 | −1200 | −2274 | −2765 | −2501 | −3071 | −2221 | −1658 | −1948 | −2205 | −2512 | 1225 | −739 | −1842 | −3322 | −3078 | 219 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 214(I) | −1924 | −1546 | −4067 | −3658 | 2312 | −3663 | −2081 | 3030 | −3367 | 150 | 99 | −3197 | −3492 | −2821 | −3179 | −2894 | −1877 | 293 | −1445 | −692 | 220 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 215(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 221 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 216(A) | 2389 | −814 | −2506 | −2162 | −1696 | −1545 | −1698 | −499 | −1942 | −1398 | −813 | −1640 | −2076 | −1723 | −2027 | −806 | 1148 | 1559 | −2200 | −1856 | 222 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 217(M) | −2576 | −2118 | −4725 | −4165 | −461 | −4430 | −3165 | 99 | −3811 | 2513 | 3454 | −4075 | −3839 | −2978 | −3488 | −3704 | −2457 | −591 | −2111 | −2145 | 223 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 218(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 224 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 219(M) | −2313 | −1968 | −4258 | −3765 | −518 | −3966 | −2806 | 98 | −3289 | 1292 | 4523 | −3599 | −3636 | −2769 | −3097 | −3249 | −2243 | −457 | −2026 | −1874 | 225 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 220(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 226 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 221(L) | −2631 | −2159 | −4786 | −4228 | −462 | −4506 | −3231 | 96 | −3878 | 2828 | 2482 | −4157 | −3880 | −3016 | −3541 | −3793 | −2509 | −608 | −2134 | −2182 | 227 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 222(P) | −1501 | −1778 | −2473 | −2371 | −1710 | −2311 | −2045 | −1321 | −2060 | 827 | −1068 | −2173 | 3594 | −2082 | −2130 | −1799 | −1699 | −1373 | −2373 | −1942 | 228 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 223(Y) | −1068 | −1670 | −865 | −836 | −631 | 1198 | −767 | −1828 | −1059 | −1914 | −1304 | 692 | −2203 | −906 | −1387 | −1136 | −1163 | −1566 | −1185 | 3670 | 229 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 224(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 230 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 225(S) | 1172 | −954 | −2367 | −2422 | −3120 | −1204 | −2237 | −2835 | −2426 | −3122 | −2265 | −1621 | −1948 | −2145 | −2467 | 3107 | −749 | −1884 | −3349 | −3092 | 231 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 226(S) | −342 | −975 | −2176 | −2124 | −2912 | −1229 | −2003 | −2594 | −2067 | −2878 | −2048 | −1510 | −1936 | −1866 | −2184 | 2553 | 2492 | −1773 | −3143 | −2833 | 232 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 227(M) | −720 | −1440 | −710 | −343 | −1228 | −1693 | 2436 | −1209 | −132 | −1364 | 3099 | 1904 | −1852 | −183 | −458 | −776 | −680 | −1004 | −1540 | −890 | 233 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 228(P) | 2240 | −1100 | −2241 | −2293 | −3037 | −1346 | −2188 | −2683 | −2317 | −2986 | −2210 | −1663 | 3041 | −2093 | −2391 | −722 | −895 | −1893 | −3243 | −2998 | 234 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | | |
|---|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | | |
| 229(A) | 2958 | −1235 | −1299 | −1377 | −2868 | −1345 | −1673 | −2580 | −1661 | −2843 | −2054 | 1555 | −1995 | −1468 | −1921 | −715 | −888 | −1871 | −3064 | −2630 | 235 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 230(E) | −509 | −1046 | −884 | 1564 | −1116 | −1669 | −441 | −485 | −283 | 250 | −206 | −577 | 689 | −200 | −656 | −670 | −459 | 1290 | −1467 | −995 | 236 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 231(D) | −1203 | −2412 | 2595 | −117 | −3286 | −1536 | −1057 | −3176 | −1165 | −3186 | −2436 | −428 | −2068 | −736 | −1824 | 2377 | −1366 | −2578 | −3334 | −2552 | 237 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 232(Q) | 954 | −1983 | −100 | 971 | −2337 | 177 | −267 | −2067 | 81 | −2060 | −1189 | −125 | −1637 | 2600 | −418 | −514 | −597 | −1649 | −2268 | −1597 | 238 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 233(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 239 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 234(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 240 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 235(R) | 377 | −1802 | −415 | 988 | −2095 | −1474 | −95 | −1786 | 1452 | −1785 | −911 | −135 | −1560 | 343 | 1555 | −409 | −431 | 376 | −1986 | −1375 | 241 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 236(D) | 1083 | −1565 | 2662 | −244 | −1941 | −1573 | −679 | 612 | −527 | −1651 | −980 | −490 | −1869 | −358 | −1003 | −771 | −766 | −903 | −2208 | −1633 | 242 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 237(E) | −1225 | −2868 | 1894 | 1948 | −3149 | −1532 | −671 | −2975 | −630 | −2902 | −2101 | −150 | −1935 | −293 | −1299 | 1884 | −1241 | −2496 | −3093 | −2248 | 243 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 238(C) | 1375 | 3262 | −2620 | −2108 | −827 | −1866 | −1267 | 1631 | −1811 | −599 | −10 | −1674 | −2137 | −1531 | −1786 | −1034 | 790 | 249 | −1361 | −1010 | 244 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 239(E) | 635 | −1796 | 1055 | 1761 | −2018 | −1464 | −263 | 1191 | 28 | −1767 | −946 | −148 | −1637 | 135 | −481 | −520 | −553 | −1300 | −2077 | −1441 | 245 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 240(E) | 593 | −2044 | −252 | 2548 | −2437 | −1542 | −329 | −2133 | 151 | −2120 | −1274 | −244 | −1738 | 89 | 946 | −646 | −717 | −1734 | −2305 | −1686 | 246 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 241(S) | 1884 | −835 | −1962 | −1576 | −1634 | −1436 | −1320 | 1041 | −1409 | −1453 | −781 | −1293 | −1922 | −1241 | −1606 | 1973 | −597 | −669 | −2036 | −1656 | 247 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 242(G) | 2267 | −1043 | −2388 | −2526 | −3253 | 2642 | −2373 | −2975 | −2639 | −3260 | −2410 | −1722 | −2033 | −2311 | −2648 | −663 | −860 | −2005 | −3436 | −3250 | 248 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 243(R) | −876 | −2087 | −829 | 1490 | −2474 | −1766 | −229 | −2106 | 1269 | −44 | −1198 | −424 | −1829 | 205 | 2225 | −775 | −768 | −1753 | −2143 | −1647 | 249 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 244(V) | 2339 | −967 | −2970 | −2766 | −1878 | −1847 | −2252 | 32 | −2541 | −1299 | −918 | −2087 | −2399 | −2316 | −2545 | −1157 | −971 | 2345 | −2605 | −2251 | 250 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 245(I) | −1827 | −1398 | −4307 | −3831 | −1099 | −3939 | −3142 | 2286 | −3619 | 1835 | 69 | −3579 | −3671 | −3177 | −3511 | −3178 | −1781 | 1918 | −2524 | −2310 | 251 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 246(V) | −1178 | −1448 | −1943 | −1452 | −1776 | −2261 | −1140 | −227 | 1866 | −1260 | −816 | −1444 | −2448 | −902 | −540 | −1496 | −1176 | 2697 | −2161 | −1764 | 252 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 247(E) | −508 | −1976 | 840 | 1547 | −2280 | −1393 | −117 | −2029 | 1400 | −1984 | −1077 | 1158 | −1531 | 330 | −253 | −378 | −454 | 262 | −2163 | −1471 | 253 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 248(M) | 1703 | −991 | −2901 | −2342 | −528 | −2567 | −1550 | 166 | −2031 | 1544 | 2668 | −2104 | −2591 | −1715 | −2010 | −1685 | −1052 | −12 | −1442 | −1177 | 254 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 249(I) | −1947 | −1516 | −4385 | −3885 | −916 | −4013 | −3118 | 2193 | −3656 | 2186 | 257 | −3656 | −3687 | −3109 | −3494 | −3250 | −1889 | 1383 | −2397 | −2258 | 255 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 250(E) | −1322 | −2647 | −272 | 2491 | −3071 | −1811 | −576 | −2759 | 2306 | −2633 | −1854 | −464 | −2066 | −175 | −177 | −1144 | −1256 | −2368 | −2692 | −2140 | 256 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 251(K) | −1395 | −2059 | −1711 | −1014 | −2215 | −2218 | −641 | −1709 | 3021 | −1652 | 2578 | −1075 | −2303 | −282 | 287 | −1423 | −1283 | −1603 | −2159 | −1803 | 257 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 252(D) | −1285 | −2888 | 2677 | 176 | −3210 | 1189 | −737 | −3047 | −715 | −2977 | −2195 | −190 | −1979 | 2106 | −1379 | −1050 | −1315 | −2564 | −3161 | −2320 | 258 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 253(I) | −2073 | −1632 | −4434 | −3975 | −911 | −4130 | −3238 | 3164 | −3706 | 1451 | 244 | −3779 | −3785 | −3187 | −3557 | −3413 | −2021 | 546 | −2449 | −2273 | 259 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 254(K) | −1570 | −2144 | −1887 | −1191 | −2098 | −2363 | −750 | −1603 | 3034 | 938 | −1112 | −1231 | −2436 | −408 | 215 | −1616 | −1443 | −1580 | −2166 | −1804 | 260 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 255(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 261 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 256(R) | −928 | −1705 | −1507 | −1055 | −2761 | −1730 | −896 | −2490 | −44 | −2489 | −1723 | −1042 | −2102 | −543 | 2614 | 2258 | −1053 | −1998 | −2546 | −2158 | 262 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 257(D) | −1280 | −2865 | 3154 | 175 | −3194 | −1547 | −743 | −3034 | −728 | −2971 | −2194 | −190 | −1979 | 1342 | −1391 | 553 | −1316 | −2552 | −3161 | −2317 | 263 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 258(I) | −1997 | −1562 | −4355 | −3927 | −1042 | −4066 | −3261 | 3343 | −3654 | 937 | 97 | −3718 | −3783 | −3239 | −3555 | −3364 | −1959 | 702 | −2549 | −2295 | 264 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 259(M) | −2252 | −1821 | −4572 | −3991 | −530 | −4164 | −2990 | 2068 | −3709 | 1993 | 3197 | −3808 | −3685 | −2916 | −3406 | −3378 | −2149 | −172 | −2084 | −2091 | 265 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 260(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 266 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 261(R) | −2131 | −2786 | −2704 | −1460 | −3618 | −2638 | −587 | −2976 | 1735 | −2645 | −1985 | −1353 | −2603 | −173 | 3492 | −2020 | −1828 | −2748 | −2484 | −2384 | 267 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 262(K) | −1349 | −2635 | −381 | 2083 | −3083 | −1857 | −565 | −2750 | 2690 | −2612 | −1837 | −514 | −2090 | −161 | −61 | −1178 | −1271 | −2369 | −2655 | −2138 | 268 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 263(A) | 2821 | −932 | −2451 | −2472 | −3065 | −1198 | −2233 | −2763 | −2434 | −3056 | −2201 | −1633 | −1940 | −2147 | −2468 | 1831 | −730 | −1840 | −3305 | −3055 | 269 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 264(F) | −2063 | −1686 | −4037 | −3677 | 3437 | −3644 | −1706 | 2063 | −3359 | 135 | 67 | −3095 | −3486 | −2739 | −3127 | −2876 | −2012 | −83 | −1038 | −158 | 270 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 265(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 271 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 266(N) | −1662 | −3306 | 2055 | 78 | −3621 | −1643 | −1040 | −3622 | −1272 | −3531 | −2870 | 3477 | −2182 | −724 | −2071 | −1371 | −1757 | −3092 | −3633 | −2700 | 272 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 267(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 273 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 268(I) | −1760 | −1307 | −4325 | −3962 | −1735 | −4042 | −3726 | 3135 | −3828 | −579 | −515 | −3722 | −3869 | −3673 | −3896 | −3359 | −1752 | 2276 | −3240 | −2806 | 274 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 269(T) | 1428 | −904 | −2334 | −2158 | −2747 | −1206 | −1940 | −2392 | −2037 | −2678 | −1846 | −1504 | −1896 | −1809 | −2163 | 902 | 3001 | −1635 | −2999 | −2705 | 275 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 270(V) | −1745 | −1300 | −4286 | −3858 | −1446 | −3967 | −3370 | 2358 | −3688 | 852 | −261 | −3606 | −3749 | −3403 | −3673 | −3232 | −1717 | 2643 | −2856 | −2524 | 276 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 271(V) | −1404 | −1072 | −3766 | −3305 | −1464 | −3356 | −2696 | 2276 | −3080 | −616 | −379 | −3001 | −3325 | −2870 | −3091 | −2563 | 1344 | 2521 | −2516 | −2113 | 277 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 272(M) | 866 | −1113 | −2656 | −2412 | −1322 | −1920 | −1883 | −487 | −2061 | −587 | 4451 | −1950 | −2387 | −1928 | −2078 | −1220 | −1053 | −498 | −2134 | −1803 | 278 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 273(A) | 2601 | −957 | −2898 | −2711 | −1943 | −1740 | −2211 | −165 | −2487 | −1406 | −1001 | −2008 | −2320 | −2260 | −2494 | −1053 | −929 | 1990 | −2626 | −2279 | 279 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 274(L) | −1171 | −983 | −3266 | −2733 | −796 | −2795 | −1888 | 590 | −2418 | 2001 | 198 | −2418 | −2816 | −2106 | −2362 | −1944 | 965 | 1777 | −1724 | −1426 | 280 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 275(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 281 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 276(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 282 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 277(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 283 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 278(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 284 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 279(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 285 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 280(A) | 3134 | −934 | −2491 | −2567 | −3083 | −1203 | −2300 | −2766 | −2540 | −3082 | −2237 | −1672 | −1954 | −2240 | −2537 | 874 | −747 | −1844 | −3333 | −3093 | 286 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 281(V) | −984 | −1045 | −3169 | −2909 | −1709 | −2304 | −2404 | 531 | −2643 | −988 | −697 | −2378 | −2722 | −2480 | −2661 | −1601 | 1504 | 3014 | −2588 | −2201 | 287 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 282(L) | −2631 | −2159 | −4786 | −4228 | −462 | −4506 | −3231 | 96 | −3878 | 2828 | 2482 | −4157 | −3880 | −3016 | −3541 | −3793 | −2509 | −608 | −2134 | −2182 | 288 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 283(H) | −3205 | −3079 | −2723 | −2890 | −2110 | −3046 | 5295 | −4135 | −2617 | −3813 | −3561 | −2886 | −3482 | −2833 | −2620 | −3291 | −3356 | −3895 | −2397 | −1681 | 289 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 284(L) | −1623 | −1338 | −3726 | −3164 | −251 | −3255 | −1820 | 1373 | −2808 | 2371 | 514 | −2785 | −3086 | −2281 | −2613 | −2389 | −1543 | −161 | −1311 | 1782 | 290 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 285(L) | −2333 | −1873 | −4640 | −4127 | −650 | −4326 | −3241 | 2176 | −3843 | 2519 | 523 | −3982 | −3833 | −3105 | −3579 | −3604 | −2247 | 56 | −2268 | −2230 | 291 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 286(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 292 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 287(M) | −1886 | −1507 | −4178 | −3693 | −877 | −3806 | −2901 | 3008 | −3380 | 335 | 3109 | −3451 | −3570 | −2934 | −3251 | −3044 | −1840 | 524 | −2288 | −2089 | 293 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 288(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 294 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 289(H) | −1490 | −2484 | −362 | −476 | −1816 | −1880 | 4320 | −2854 | −684 | −2770 | −2133 | 2185 | −2285 | −728 | −1000 | −1377 | −1550 | −2475 | −2146 | −1255 | 295 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 290(A) | 2439 | −911 | −2326 | −2131 | −2811 | −1197 | −1934 | −2480 | −2011 | −2745 | −1898 | −1490 | −1888 | −1785 | −2153 | 1898 | 1073 | −1682 | −3044 | −2749 | 296 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 291(I) | 2038 | −985 | −3388 | −2919 | −1320 | −2893 | −2277 | 2155 | −2677 | −587 | −297 | −2593 | −2992 | −2450 | −2697 | −2087 | −1208 | 1681 | −2229 | −1846 | 297 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 292(G) | −1243 | −2769 | 311 | 1902 | −3172 | 1980 | −744 | −2992 | −697 | −2936 | −2152 | 1923 | −1974 | −377 | −1331 | −1030 | −1284 | −2506 | −3125 | −2308 | 298 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 293(V) | −1738 | −1298 | −4281 | −3921 | −1737 | −3979 | −3665 | 1917 | −3774 | −601 | −528 | −3671 | −3834 | −3628 | −3843 | −3293 | −1735 | 3205 | −3215 | −2770 | 299 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 294(E) | −833 | −2344 | 1092 | 2412 | −2643 | −1464 | −386 | −2413 | −146 | −2369 | −1505 | −96 | 562 | 29 | −717 | −666 | 862 | −1966 | −2562 | −1818 | 300 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 295(W) | −1380 | −1116 | −3614 | −3026 | 1322 | −2981 | −1582 | 1966 | −2661 | 1775 | 556 | −2562 | −2865 | −2117 | −2424 | −2098 | −1302 | −187 | 2908 | −629 | 301 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 296(T) | −350 | −973 | −2204 | −2178 | −2893 | −1236 | −2035 | −2561 | −2117 | −2862 | −2043 | −1536 | −1946 | −1916 | −2214 | 1618 | 3198 | −1758 | −3137 | −2831 | 302 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 297(L) | −1443 | −1269 | −3144 | −2576 | −528 | −3014 | −1816 | 1945 | −2155 | 2102 | 508 | −2422 | −2899 | 1193 | −2133 | −2129 | −1369 | −50 | −1616 | −1384 | 303 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 298(D) | −1826 | −3682 | 3559 | 1199 | −3883 | −1662 | −1073 | −3846 | −1391 | −3720 | −3110 | −272 | −2222 | −760 | −2283 | −1471 | −1913 | −3321 | −3864 | −2864 | 304 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 299(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 305 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 300(F) | −3342 | −2776 | −4026 | −4232 | 4354 | −3545 | −1431 | −2315 | −4038 | −1801 | −1900 | −3299 | −3780 | −3350 | −3645 | −3490 | −3420 | −2566 | −739 | 349 | 306 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 301(Q) | −1048 | −2608 | 205 | 2170 | −2893 | −1535 | −505 | −2680 | −255 | −2604 | −1769 | 1814 | −1849 | 2272 | −789 | −848 | −1028 | −2228 | −2770 | −2013 | 307 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 302(R) | 1083 | −1687 | 691 | 135 | −2058 | −1406 | −178 | −1755 | 214 | −1793 | −924 | −145 | −1553 | 247 | 1670 | −383 | 1217 | −1367 | −2031 | −1404 | 308 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 303(I) | −1915 | −1536 | −4077 | −3667 | 2027 | −3678 | −2155 | 3137 | −3381 | 144 | 94 | −3225 | −3506 | −2848 | −3202 | −2914 | −1871 | 345 | −1522 | −791 | 309 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 304(R) | −689 | −2015 | −494 | 24 | −2395 | −1582 | −184 | −2087 | 444 | −2020 | −1151 | 1161 | −1687 | 1832 | 2131 | 626 | −614 | −1684 | −2156 | −1573 | 310 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 305(D) | 387 | −1967 | 1600 | 1359 | −2275 | −1391 | 1561 | −2025 | 282 | −1976 | −1067 | −25 | −1525 | 342 | 1024 | −369 | −443 | −1584 | −2152 | −1462 | 311 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 306(R) | −1460 | −2315 | −1793 | −887 | −2832 | −2237 | −431 | −2288 | 2193 | −2199 | −1473 | −946 | −2245 | −20 | 2706 | −1394 | −1275 | 591 | −2248 | −1961 | 312 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 307(V) | −941 | −1027 | −3099 | −2832 | −1692 | −2234 | −2324 | 470 | −2565 | −1003 | −695 | −2305 | −2663 | −2399 | −2587 | −1527 | 1858 | 2876 | −2536 | −2152 | 313 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 308(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 314 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 309(V) | −1090 | −1215 | −2097 | −1824 | −819 | −2221 | 2699 | −287 | −1392 | −1027 | −591 | −1674 | −2482 | −1446 | −1482 | −1482 | −1143 | 2879 | −1420 | −707 | 315 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 310(L) | −2439 | −1972 | −4702 | −4181 | −588 | −4401 | −3258 | 1582 | −3881 | 2757 | 587 | −4061 | −3862 | −3093 | −3590 | −3689 | −2344 | −130 | −2230 | −2217 | 316 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 311(C) | 2157 | 4166 | −3012 | −2973 | −2780 | 1022 | −2337 | −2398 | −2724 | −2744 | −1930 | −1786 | −1943 | −2372 | −2623 | −540 | −692 | −1624 | −3091 | −2881 | 317 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 312(D) | −1732 | −3453 | 3468 | 99 | −3733 | −1645 | −1066 | −3747 | −1356 | −3641 | −3008 | 1690 | −2201 | −755 | −2209 | −1416 | −1833 | −3208 | −3752 | −2776 | 318 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 313(L) | −2477 | −2023 | −4713 | −4122 | 1592 | −4329 | −2920 | 72 | −3835 | 2593 | 2472 | −3948 | −3754 | −2914 | −3466 | −3550 | −2350 | −634 | −1927 | −1830 | 319 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 314(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 320 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 315(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 321 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 316(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 322 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 317(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 323 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 318(K) | 2 | −2257 | −1073 | −374 | −2740 | −1908 | −278 | −2339 | 2328 | −2192 | −1373 | −562 | −1953 | 2273 | 1344 | −952 | −933 | −1980 | −2234 | −1799 | 324 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 319(Y) | −3482 | −2868 | −3701 | −3919 | 238 | −3552 | −1112 | −3000 | −3638 | −2516 | −2526 | −3027 | −3772 | −3101 | −3341 | −3418 | −3527 | −3071 | −441 | 4711 | 325 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 320(M) | −1559 | −1267 | −3829 | −3380 | −1103 | −3357 | −2655 | 805 | −3067 | −64 | 3046 | −3065 | −3326 | −2779 | −3011 | −2591 | −1556 | 2855 | −2312 | −1998 | 326 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 321(M) | 1225 | −469 | −2256 | −1679 | 1656 | −1926 | −870 | 90 | −1396 | −210 | 2763 | −1424 | −2028 | −1129 | −1411 | −1008 | 712 | 154 | −951 | −586 | 327 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 322(T) | −738 | −2094 | −84 | 1704 | −2416 | −1495 | −317 | −2135 | 61 | −2127 | −1275 | −163 | −1704 | 1857 | −405 | −613 | 1930 | −1734 | −2331 | −1668 | 328 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 323(D) | −1746 | −3458 | 3540 | 90 | −3744 | −1650 | −1081 | −3767 | −1381 | −3662 | −3036 | 1386 | −2211 | −772 | −2239 | −1429 | −1850 | −3226 | −3765 | −2789 | 329 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 324(L) | −2451 | −1983 | −4707 | −4186 | −582 | −4409 | −3259 | 1510 | −3884 | 2778 | 592 | −4069 | −3865 | −3091 | −3590 | −3698 | −2355 | −150 | −2226 | −2214 | 330 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 325(H) | −2923 | −2573 | −2959 | −2926 | 826 | −3449 | 4553 | −2508 | −2463 | −2054 | −1948 | −2279 | −3499 | −2191 | −2397 | −2761 | −2855 | −2540 | 123 | 2920 | 331 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 326(K) | 373 | −1957 | −342 | 1025 | −2297 | −1472 | −98 | −2018 | 2111 | −1954 | −1056 | 906 | −1570 | 352 | 685 | −424 | −473 | −1592 | −2105 | −1469 | 332 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 327(V) | 1739 | −1008 | −3509 | −3043 | −1376 | −3028 | −2406 | 1765 | −2807 | −615 | −334 | −2718 | −3093 | −2585 | −2823 | −2226 | −1263 | 2376 | −2322 | −1931 | 333 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 328(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 334 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 329(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 335 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 330(I) | −1758 | −1302 | −4331 | −3970 | −1756 | −4054 | −3748 | 2976 | −3840 | −603 | −533 | −3731 | −3877 | −3693 | −3914 | −3372 | −1750 | 2505 | −3265 | −2824 | 336 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 331(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 337 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 332(Q) | 1795 | −1440 | −730 | −492 | −2453 | 682 | −812 | −2151 | −508 | −2256 | −1426 | −624 | −1796 | 2666 | −901 | −590 | −689 | −1636 | −2510 | −1971 | 338 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 333(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 339 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 334(M) | −2355 | −1988 | −4343 | −3834 | −504 | −4051 | −2868 | 105 | −3385 | 1451 | 4460 | −3680 | −3671 | −2806 | −3171 | −3327 | −2274 | −474 | −2039 | −1925 | 340 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 335(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 341 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 336(Y) | −1187 | −974 | −3186 | −2638 | −117 | −2732 | −1255 | 1905 | −2270 | 73 | 1977 | −2217 | −2699 | −1882 | −2144 | −1841 | −1124 | 71 | −907 | 3254 | 342 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 337(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 343 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 338(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 344 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 339(K) | −864 | −1785 | −860 | −366 | −2128 | −1763 | −407 | −1612 | 2624 | −1800 | −1045 | 629 | −1900 | −28 | 62 | −851 | −805 | 1127 | −2064 | −1581 | 345 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 340(N) | 602 | −1686 | −275 | 1008 | −1926 | −1415 | 1528 | −1618 | 244 | −1673 | −815 | 1897 | −1530 | 299 | −244 | −371 | −391 | 322 | −1934 | −1306 | 346 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 341(G) | −1709 | −2639 | 1362 | −690 | −3785 | 3257 | −1671 | −3805 | −1946 | −3792 | −3137 | −980 | −2480 | −1424 | −2576 | −1630 | −1936 | −3150 | −3628 | −3155 | 347 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 342(F) | −942 | −799 | −2828 | −2226 | 1797 | −2476 | −1269 | 1109 | 581 | 1793 | 516 | −1952 | −2453 | −1557 | −1815 | −1558 | −875 | 52 | −1138 | −794 | 348 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 343(L) | −2451 | −1983 | −4707 | −4186 | −582 | −4409 | −3259 | 1510 | −3884 | 2778 | 592 | −4069 | −3865 | −3091 | −3590 | −3698 | −2355 | −150 | −2226 | −2214 | 349 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 344(H) | −3205 | −3079 | −2723 | −2890 | −2110 | −3046 | 5295 | −4135 | −2617 | −3813 | −3561 | −2886 | −3482 | −2833 | −2620 | −3291 | −3356 | −3895 | −2397 | −1681 | 350 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 345(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 351 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 346(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 352 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 347(C) | 774 | 4452 | −2162 | −1688 | −1962 | −1478 | −1302 | −1474 | −944 | −1796 | −1088 | −1351 | −1979 | −1147 | 1684 | −732 | −719 | −1116 | −2225 | −1881 | 353 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 348(L) | −2387 | −1922 | −4674 | −4155 | −617 | −4366 | −3250 | 1889 | −3865 | 2650 | 558 | −4023 | −3847 | −3098 | −3586 | −3647 | −2296 | −38 | −2247 | −2224 | 354 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 349(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 355 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 350(C) | −1489 | 2972 | −4007 | −3563 | −1524 | −3541 | −2939 | 2612 | −3350 | −617 | −413 | −3224 | −3470 | −3129 | −3335 | −2770 | −1475 | 2269 | −2657 | −2248 | 356 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 351(T) | −364 | −979 | −2232 | −2250 | −2904 | −1245 | −2090 | −2559 | −2191 | −2881 | −2075 | −1571 | −1964 | −1991 | −2260 | 905 | 3428 | −1762 | −3159 | −2858 | 357 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 352(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 358 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 353(K) | −1716 | −2632 | −2004 | −1008 | −3336 | −2379 | −444 | −2764 | 2775 | −2484 | −1756 | −1035 | −2357 | 2151 | 1811 | −1592 | −1477 | −2481 | −2391 | −2172 | 359 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 354(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 360 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 355(V) | −1771 | −1339 | −4275 | −3816 | −1235 | −3919 | −3194 | 2139 | −3617 | 1520 | −66 | −3558 | −3681 | −3244 | −3547 | −3164 | −1733 | 2390 | −2634 | −2369 | 361 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 356(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 362 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 357(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 363 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 358(N) | −823 | −1917 | −96 | 1188 | −2187 | −1547 | −506 | −1711 | −265 | −1955 | −1191 | 2711 | −1815 | −144 | −747 | −757 | −815 | 1140 | −2297 | −1666 | 364 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 359(L) | −2153 | −1779 | −4360 | −3884 | −675 | −3965 | −3012 | 392 | −3561 | 2726 | 467 | −3673 | −3662 | −2955 | −3355 | −3239 | −2102 | 1281 | −2207 | −2099 | 365 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 360(E) | 1136 | −2084 | −175 | 2027 | −2436 | −1510 | −274 | −2147 | 1525 | −2118 | −1254 | −175 | −1692 | 152 | −251 | −593 | −670 | −1736 | −2296 | −1650 | 366 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 361(H) | 893 | −1761 | 1357 | 214 | −2092 | −1387 | 1862 | −1810 | 229 | −1825 | −942 | −83 | −1527 | 293 | −273 | 640 | 793 | −1409 | −2050 | −1397 | 367 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 362(I) | 608 | −458 | −2776 | −2176 | 1666 | −2202 | −1113 | 1712 | −1836 | −222 | 338 | −1782 | −2245 | −1512 | −1731 | −1292 | 867 | 1366 | −1036 | −684 | 368 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 363(P) | −922 | −1912 | 1681 | −141 | −2123 | −1604 | −687 | −1787 | −550 | 187 | −1245 | −427 | 2677 | −363 | −1049 | −882 | −947 | −1524 | −2338 | −1711 | 369 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 364(D) | −1692 | −3605 | 3364 | 1256 | −3770 | −1599 | −957 | −3700 | −1216 | −3569 | −2909 | 1025 | −2138 | −628 | −2083 | −1346 | −1761 | −3174 | −3765 | −2738 | 370 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 365(Q) | −877 | −1646 | −633 | 499 | −1610 | −1781 | −505 | −1210 | −63 | 1648 | −649 | −558 | −1931 | 2241 | −360 | −907 | −814 | −1097 | −1882 | −1385 | 371 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 366(P) | −648 | −2019 | 1139 | 203 | −2354 | −1436 | −285 | −2089 | 29 | −2086 | −1217 | −114 | 1965 | 1445 | −492 | −529 | 1244 | −1672 | −2300 | −1616 | 372 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −571 | −7108 | −1646 | −894 | −1115 | −701 | −1378 | * | * | | | | | | | | | | | | |
| 367(R) | −422 | −1009 | −851 | −304 | 1406 | −1496 | −183 | −740 | 147 | −894 | −230 | −440 | 775 | 21 | 2009 | −539 | −381 | −568 | −1136 | −521 | 373 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −23 | −6560 | −7602 | −894 | −1115 | −341 | 2249 | * | * | | | | | | | | | | | | |
| 368(D) | 1472 | −1668 | 1835 | −70 | −2356 | −1385 | −511 | −2062 | −246 | −2128 | −1275 | −318 | 1353 | −118 | −746 | −526 | 425 | −1602 | −2380 | −1752 | 374 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 369(G) | −1044 | −2230 | 2141 | −100 | −3222 | 2291 | −982 | −3045 | −1033 | −3050 | −2258 | −395 | −1985 | −644 | −1669 | 858 | −1207 | −2428 | −3250 | −2493 | 375 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 370(Q) | −2562 | −2904 | −1886 | −1971 | −3251 | −2661 | −2079 | −3690 | −1565 | −3469 | −3081 | −2107 | −3091 | 4371 | −1665 | −2585 | −2674 | −3411 | −3077 | −2821 | 376 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 371(D) | −1275 | −2955 | 2862 | 1330 | −3205 | −1556 | −670 | −3029 | 1509 | −2936 | −2141 | −158 | −1955 | −290 | −1213 | −1025 | −1281 | −2554 | −3111 | −2272 | 377 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 372(V) | −1738 | −1298 | −4281 | −3921 | −1737 | −3979 | −3665 | 1917 | −3774 | −601 | −528 | −3671 | −3834 | −3628 | −3843 | −3293 | −1735 | 3205 | −3215 | −2770 | 378 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 373(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 379 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 374(M) | −584 | −1354 | −847 | −246 | −1467 | −1659 | 2505 | −1087 | 212 | −374 | 2571 | −449 | −1729 | 1171 | 1074 | −634 | −507 | −876 | −1617 | −1128 | 380 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 375(P) | −910 | −2031 | −73 | 1195 | −2792 | −1488 | −794 | −2539 | −629 | −2588 | −1788 | −401 | 3005 | −439 | −1131 | 612 | −1014 | −2050 | −2815 | −2151 | 381 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 376(W) | −1588 | −1300 | −3783 | −3197 | −329 | −3245 | −1926 | 2071 | −2827 | 1901 | 558 | −2822 | −3072 | −2297 | −2616 | −2381 | −1508 | −111 | 3483 | −1042 | 382 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 377(E) | −1024 | −2640 | 1844 | 2310 | −2908 | −1498 | −505 | −2711 | −344 | −2636 | −1791 | −107 | −1824 | 1521 | −957 | 207 | −1011 | −2243 | −2817 | −2021 | 383 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 378(N) | −826 | −2349 | 1089 | 227 | −2651 | −1487 | −341 | −2416 | 1494 | −2346 | −1475 | 2601 | −1724 | 1005 | −522 | −657 | −787 | −1968 | −2511 | −1791 | 384 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 379(P) | 1932 | −1116 | −2232 | −2301 | −3058 | −1358 | −2206 | −2706 | −2336 | −3009 | −2238 | −1674 | 3274 | −2114 | −2406 | −739 | −914 | −1913 | −3260 | −3019 | 385 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 380(V) | −914 | −773 | −2713 | −2129 | −712 | −2505 | −1388 | 1452 | 1084 | 1324 | 204 | −1926 | −2507 | −1580 | −1808 | −1591 | −859 | 1713 | −1424 | −1081 | 386 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 381(Y) | −1484 | −2331 | −1762 | −887 | −2436 | −2254 | −420 | −2325 | 2137 | −2195 | −1475 | −949 | −2258 | −39 | 1983 | −1411 | −1295 | −2075 | −2087 | 2868 | 387 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 382(E) | 1256 | −1890 | −206 | 1353 | −2196 | −1401 | −89 | −1930 | 812 | −1898 | −996 | −45 | 547 | 1252 | −162 | −356 | −414 | −1507 | −2083 | −1416 | 388 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 383(Q) | −752 | −2272 | 1586 | 1407 | −2561 | −1448 | −308 | −2329 | −23 | −2276 | −1396 | −71 | −1677 | 1749 | −577 | −590 | 1569 | −1881 | −2459 | −1727 | 389 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 384(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 390 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 385(H) | −964 | −2089 | −200 | −136 | −2264 | −1600 | 3833 | −2320 | −296 | −2338 | −1558 | 1362 | 1479 | −276 | −699 | −881 | −992 | −1924 | −2364 | −1652 | 391 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 386(L) | −2451 | −1983 | −4707 | −4186 | −582 | −4409 | −3259 | 1510 | −3884 | 2778 | 592 | −4069 | −3865 | −3091 | −3590 | −3698 | −2355 | −150 | −2226 | −2214 | 392 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 387(Q) | 1643 | −1017 | −1196 | −721 | −1189 | −1714 | −668 | 1336 | −497 | −907 | −297 | −823 | −1893 | 2044 | −794 | −784 | −569 | −339 | −1579 | −1135 | 393 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 388(I) | −1760 | −1308 | −4323 | −3961 | −1730 | −4039 | −3721 | 3156 | −3825 | −575 | −512 | −3720 | −3867 | −3669 | −3893 | −3356 | −1753 | 2241 | −3236 | −2802 | 394 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 389(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 395 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 390(K) | −1259 | −2115 | −1267 | −676 | −970 | −2105 | 1794 | −2040 | 2549 | −1955 | −1282 | −808 | −2165 | −167 | 114 | −1192 | −1140 | −1801 | −1301 | 2517 | 396 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 391(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 397 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 392(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 398 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 393(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 399 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 394(A) | 3121 | −934 | −2489 | −2561 | −3081 | −1203 | −2295 | −2766 | −2533 | −3080 | −2234 | −1669 | −1953 | −2234 | −2533 | 936 | −746 | −1844 | −3331 | −3090 | 400 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 395(E) | −522 | −1773 | −240 | 1676 | −2248 | −1396 | −289 | −1968 | 50 | −1989 | −1115 | −174 | 1198 | 131 | −448 | 1226 | 677 | −1538 | −2214 | −1565 | 401 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 396(E) | −1481 | −3230 | 1425 | 2936 | −3481 | 751 | −843 | −3354 | −954 | −3256 | −2520 | −187 | −2057 | −492 | −1711 | −1193 | −1527 | −2852 | −3445 | −2523 | 402 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 397(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 403 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 398(A) | 2847 | −932 | −2454 | −2477 | −3066 | −1198 | −2236 | −2763 | −2439 | −3057 | −2202 | −1635 | −1940 | −2152 | −2471 | 1777 | −731 | −1840 | −3306 | −3056 | 404 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 399(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 405 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 400(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 406 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 401(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 407 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 402(I) | −1761 | −1312 | −4317 | −3954 | −1713 | −4027 | −3703 | 3225 | −3814 | −556 | −498 | −3712 | −3859 | −3653 | −3877 | −3344 | −1754 | 2110 | −3216 | −2787 | 408 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 403(S) | −348 | −981 | −2200 | −2194 | −2989 | −1227 | −2073 | −2686 | −2157 | −2970 | −2136 | −1541 | −1946 | −1946 | −2253 | 3060 | 1398 | −1824 | −3217 | −2916 | 409 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 404(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 410 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 405(V) | −917 | −809 | −2556 | −1976 | −827 | −2491 | −1367 | 1339 | 1455 | 721 | 94 | −1841 | −2501 | −1487 | −1710 | −1570 | −863 | 2038 | −1514 | −1151 | 411 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 406(K) | −1386 | −2643 | −447 | 1824 | −3108 | −1893 | −570 | −2762 | 2860 | −2616 | −1848 | −552 | −2117 | −166 | −3 | −1217 | −1300 | −2388 | −2647 | −2154 | 412 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 407(N) | −537 | −1563 | −449 | −36 | −1889 | 1143 | −307 | −1529 | 932 | −1655 | −844 | 1794 | −1658 | 73 | −356 | −518 | −516 | 924 | −1962 | −1392 | 413 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 408(P) | −894 | −2181 | −369 | 1705 | −2576 | −1650 | −357 | −2268 | 243 | −2210 | −1375 | −330 | 2093 | 63 | 1619 | −774 | −835 | −1876 | −2347 | −1769 | 414 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 409(V) | −419 | −634 | −1376 | −807 | 1053 | −1737 | −499 | −198 | −623 | −505 | 178 | 600 | −1807 | −475 | 475 | 313 | −360 | 1389 | −1016 | 1303 | 415 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 410(I) | −1282 | −1082 | −3022 | −2555 | 2426 | −2683 | 1767 | 2555 | −2191 | −443 | −88 | −2038 | −2692 | −1794 | −2075 | −1793 | −1220 | −317 | −361 | 552 | 416 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 411(T) | −499 | −1595 | −431 | 966 | −1830 | −1487 | −185 | −1449 | 1092 | −1574 | −754 | −207 | −1601 | 213 | −206 | −458 | 2067 | 159 | −1877 | −1296 | 417 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 412(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 418 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 413(P) | −632 | −1230 | −2074 | −2144 | −2996 | −1453 | −2116 | −2631 | −2128 | −2928 | −2213 | −1658 | 3610 | −2006 | −2221 | −852 | 1302 | −1931 | −3185 | −2917 | 419 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 414(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 420 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 415(R) | −1454 | −2316 | −1780 | −878 | −2834 | −2232 | −428 | −2292 | 2281 | −2200 | −1473 | −940 | −2240 | −17 | 2627 | −1386 | −1270 | 588 | −2249 | −1960 | 421 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 416(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 422 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 417(F) | −3342 | −2776 | −4026 | −4232 | 4354 | −3545 | −1431 | −2315 | −4038 | −1801 | −1900 | −3299 | −3780 | −3350 | −3645 | −3490 | −3420 | −2566 | −739 | 349 | 423 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 418(D) | −1572 | −3426 | 2573 | 2447 | −3613 | −1583 | −879 | −3513 | −1050 | −3393 | −2684 | 1292 | −2085 | −535 | −1855 | −1253 | −1623 | −3000 | −3585 | −2609 | 424 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 419(S) | −879 | −1989 | 1498 | −177 | −3045 | 1600 | −939 | −2843 | −904 | −2867 | −2046 | −438 | −1922 | −591 | −1483 | 2171 | −1044 | −2226 | −3072 | −2372 | 425 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 420(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 426 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 421(Q) | −705 | −1925 | −199 | 2112 | 917 | −1534 | −288 | −1824 | 42 | −1842 | −1054 | −210 | −1709 | 2163 | −420 | −611 | −656 | −1502 | −1997 | −1291 | 427 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 422(H) | −569 | −2048 | 1450 | 1526 | −2349 | −1405 | 1830 | −2103 | 181 | −2058 | −1157 | −37 | −1569 | 272 | −349 | 713 | 620 | −1662 | −2240 | −1537 | 428 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 423(C) | 1626 | 2878 | −2671 | −2107 | 1264 | −1968 | −1091 | 233 | −1777 | −334 | 250 | −1672 | −2128 | −1459 | −1691 | −1096 | −529 | 1209 | −1066 | −704 | 429 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 424(M) | −2042 | −1634 | −4379 | −3826 | −659 | −3976 | −2899 | 2765 | −3546 | 1204 | 3085 | −3605 | −3604 | −2896 | −3318 | −3183 | −1961 | 195 | −2135 | −2058 | 430 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 425(E) | 412 | −2447 | 1356 | 2379 | −2747 | −1477 | −445 | −2527 | −243 | −2477 | −1622 | −107 | 855 | −36 | −831 | −730 | −894 | −2073 | −2668 | −1906 | 431 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 426(A) | 2822 | −1031 | −2418 | −2539 | −3226 | 1898 | −2364 | −2941 | −2626 | −3229 | −2379 | −1722 | −2026 | −2302 | −2634 | −654 | −848 | −1983 | −3415 | −3226 | 432 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 427(I) | −1772 | −1325 | −4307 | −3877 | −1405 | −3993 | −3383 | 2935 | −3705 | 820 | −217 | −3632 | −3761 | −3400 | −3682 | −3260 | −1742 | 2033 | −2838 | −2525 | 433 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 428(L) | −875 | −1634 | −575 | 959 | −1581 | −1769 | −525 | −1179 | −135 | 1884 | −625 | −547 | −1931 | 1405 | −450 | −909 | −816 | −1074 | −1883 | −1383 | 434 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 429(A) | 1705 | −1826 | −180 | 949 | −2318 | −1410 | −359 | −2041 | −53 | −2067 | −1204 | 1001 | −1652 | 52 | −561 | 1232 | −595 | −1609 | −2298 | −1643 | 435 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 430(D) | −1074 | −2458 | 2381 | 60 | −2921 | 1927 | −658 | −2710 | −463 | −2675 | −1860 | −271 | −1918 | −276 | 866 | −915 | −1100 | −2245 | −2845 | −2124 | 436 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 431(K) | −688 | −2117 | 785 | 888 | −2469 | −1529 | −187 | −2189 | 2380 | −2106 | −1221 | −162 | −1661 | 256 | 1134 | −553 | −619 | −1760 | −2240 | −1607 | 437 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 432(I) | −2019 | −1582 | −4380 | −3941 | −1000 | −4086 | −3253 | 3295 | −3671 | 1100 | 145 | −3736 | −3783 | −3222 | −3556 | −3378 | −1976 | 657 | −2517 | −2289 | 438 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 433(Q) | −490 | −1797 | −369 | 171 | −2078 | −1457 | 1762 | −1779 | 1157 | −1780 | −905 | 1165 | −1550 | 1798 | −48 | −396 | −422 | 725 | −1986 | −1366 | 439 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 434(A) | 1954 | −1836 | 1733 | −180 | −2714 | −1429 | −806 | −2438 | −679 | −2518 | −1698 | −430 | 1775 | −448 | −1211 | −736 | −894 | −1923 | −2765 | −2117 | 440 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 435(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 441 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 436(D) | −1736 | −3455 | 3490 | 97 | −3737 | −1646 | −1070 | −3753 | −1363 | −3647 | −3016 | 1602 | −2204 | −760 | −2218 | −1420 | −1838 | −3213 | −3756 | −2780 | 442 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 437(V) | −1721 | −1302 | −4229 | −3874 | −1705 | −3894 | −3582 | 1607 | −3706 | −582 | −513 | −3610 | −3786 | −3559 | −3767 | −3209 | −1725 | 3294 | −3158 | −2712 | 443 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 438(V) | 594 | −988 | −3391 | −2911 | −1164 | −2888 | −2187 | 845 | −2637 | 765 | −154 | −2576 | −2962 | −2387 | −2622 | −2074 | −1205 | 2800 | −2084 | −1724 | 444 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 439(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 445 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 440(I) | −1754 | −1308 | −4295 | −3867 | −1434 | −3978 | −3377 | 2661 | −3697 | 862 | −247 | −3617 | −3754 | −3406 | −3679 | −3243 | −1725 | 2373 | −2852 | −2526 | 446 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 441(R) | −2957 | −3022 | −3318 | −2735 | −3796 | −2998 | −1968 | −3912 | −846 | −3631 | −3157 | −2611 | −3280 | −1724 | 4056 | −3026 | −2913 | −3650 | −3096 | −3185 | 447 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 442(Y) | −1321 | −1438 | −1994 | −1608 | 2186 | 527 | −450 | −1117 | −1481 | −1211 | −693 | 1178 | −2522 | −1217 | −1665 | −1518 | −1275 | −1021 | −198 | 3178 | 448 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 443(C) | −675 | 2205 | −2544 | 972 | −572 | −2236 | −1121 | 1373 | −1671 | 679 | 261 | −1700 | −2270 | −1403 | −1668 | −1311 | −621 | 1601 | −1150 | −790 | 449 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 444(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 450 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 445(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 451 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 446(K) | −1060 | −2058 | −1088 | −460 | −2432 | −1917 | −357 | −1970 | 2801 | −1978 | −1220 | −632 | −1990 | 1339 | 367 | −999 | −946 | 536 | −2145 | −1717 | 452 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 447(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 453 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 448(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 454 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 449(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 455 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 450(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 456 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 451(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 457 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 452(P) | −1659 | −2241 | −2022 | −1646 | −3185 | −2242 | −1373 | −3000 | −450 | −2936 | −2274 | −1624 | 3435 | −1065 | 2095 | −1730 | −1750 | −2593 | −2816 | −2613 | 458 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 453(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 459 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 454(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 460 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 455(L) | −2871 | −2457 | −4231 | −4103 | −1033 | −3803 | −3165 | −541 | −3734 | 3130 | −31 | −3965 | −3797 | −3286 | −3484 | −3713 | −2869 | −1136 | −2394 | −2220 | 461 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 456(K) | 1368 | −1491 | −763 | −332 | −2319 | −1417 | −551 | −1998 | 1786 | −2068 | −1221 | −500 | −1721 | −160 | −470 | 1631 | −587 | −1532 | −2299 | −1754 | 462 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 457(P) | −1500 | −1738 | −2514 | −2380 | −1555 | −2358 | −2022 | −1126 | −2063 | 1224 | −841 | −2189 | 3436 | −2061 | −2129 | −1822 | −1674 | −1231 | −2290 | −1878 | 463 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 458(T) | −351 | −974 | −2208 | −2185 | −2894 | −1237 | −2041 | −2561 | −2125 | −2863 | −2046 | −1539 | −1948 | −1923 | −2218 | 1543 | 3230 | −1758 | −3139 | −2834 | 464 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 459(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 465 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 460(M) | 2706 | −986 | −2433 | −2144 | −1502 | −1684 | −1706 | −700 | −1858 | −968 | 2744 | −1705 | −2188 | −1713 | −1932 | −963 | −862 | −592 | −2145 | −1794 | 466 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 461(I) | −2103 | −1659 | −4461 | −3992 | −869 | −4152 | −3233 | 3082 | −3723 | 1619 | 290 | −3801 | −3788 | −3171 | −3557 | −3432 | −2046 | 487 | −2418 | −2265 | 467 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 462(I) | −1761 | −1312 | −4317 | −3954 | −1713 | −4027 | −3703 | 3225 | −3814 | −556 | −498 | −3712 | −3859 | −3653 | −3877 | −3344 | −1754 | 2110 | −3216 | −2787 | 468 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 463(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 469 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 464(K) | 1641 | −2033 | −323 | 914 | −2415 | −1565 | −296 | −2097 | 2052 | −2080 | −1233 | −257 | −1736 | 125 | −133 | −646 | −702 | −1707 | −2258 | −1657 | 470 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 465(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 471 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 466(L) | −1699 | −1807 | −2268 | −1925 | −830 | −2795 | −1551 | −455 | −1225 | 2510 | 90 | −1958 | −2845 | 1927 | −1308 | −2067 | −1651 | −846 | −1841 | −1454 | 472 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 467(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 473 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 468(D) | −853 | −2415 | 2115 | 1717 | −2702 | −1468 | −378 | −2484 | 1085 | −2417 | −1546 | −84 | −1732 | 41 | −699 | 696 | −824 | −2025 | −2594 | −1839 | 474 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 469(S) | −892 | −1780 | −931 | −688 | −2757 | −1643 | −830 | −2472 | 1671 | −2492 | −1708 | −799 | −2018 | −468 | −365 | 2676 | −1004 | −1981 | −2598 | −2130 | 475 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 470(C) | −1135 | 3503 | −3700 | −3406 | −1670 | −2549 | −2675 | 653 | −3101 | −916 | −667 | −2727 | −2925 | −2870 | −3030 | −1868 | −1288 | 2927 | −2619 | −2222 | 476 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 471(A) | 2590 | −1035 | −2404 | −2530 | −3236 | 2290 | −2365 | −2954 | −2627 | −3240 | −2389 | −1719 | −2027 | −2302 | −2637 | −656 | −851 | −1991 | −3423 | −3234 | 477 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 472(L) | −2632 | −2152 | −4630 | −4185 | 1767 | −4324 | −2442 | −61 | −3879 | 2789 | 563 | −3833 | −3823 | −2970 | −3513 | −3609 | −2518 | −738 | −1527 | −945 | 478 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 473(I) | −2073 | −1632 | −4434 | −3975 | −911 | −4130 | −3238 | 3164 | −3706 | 1451 | 244 | −3779 | −3785 | −3187 | −3557 | −3413 | −2021 | 546 | −2449 | −2273 | 479 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 474(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 480 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 475(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 481 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 476(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 482 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 477(R) | −2957 | −3022 | −3318 | −2735 | −3796 | −2998 | −1968 | −3912 | −846 | −3631 | −3157 | −2611 | −3280 | −1724 | 4056 | −3026 | −2913 | −3650 | −3096 | −3185 | 483 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 478(F) | −3342 | −2776 | −4026 | −4232 | 4354 | −3545 | −1431 | −2315 | −4038 | −1801 | −1900 | −3299 | −3780 | −3350 | −3645 | −3490 | −3420 | −2566 | −739 | 349 | 484 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 479(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 485 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 480(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 486 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 481(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 487 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 482(T) | −359 | −976 | −2225 | −2229 | −2900 | −1242 | −2074 | −2560 | −2170 | −2875 | −2064 | −1561 | −1958 | −1969 | −2247 | 1110 | 3375 | −1760 | −3152 | −2850 | 488 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 483(Y) | −3402 | −2632 | −3941 | −4011 | 1064 | −3924 | 3388 | −2526 | −3541 | −1996 | −1973 | −2625 | −3821 | −2664 | −3170 | −3135 | −3280 | −2619 | 3420 | 3756 | 489 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 484(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 490 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 485(M) | −2322 | −1904 | −4536 | −3951 | 2387 | −4112 | −2676 | 67 | −3649 | 2034 | 3156 | −3710 | −3633 | −2803 | −3311 | −3309 | −2204 | −588 | −1794 | −1586 | 491 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 486(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 492 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 487(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 493 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 488(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 494 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 489(H) | −3205 | −3079 | −2723 | −2890 | −2110 | −3046 | 5295 | −4135 | −2617 | −3813 | −3561 | −2886 | −3482 | −2833 | −2620 | −3291 | −3356 | −3895 | −2397 | −1681 | 495 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 490(V) | −1754 | −1297 | −4329 | −3968 | −1770 | −4053 | −3752 | 2604 | −3840 | −621 | −545 | −3728 | −3878 | −3699 | −3917 | −3370 | −1746 | 2859 | −3276 | −2829 | 496 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 491(A) | 2587 | −828 | −2477 | −2155 | −1837 | −1468 | −1728 | −743 | −1941 | −1564 | −954 | −1607 | −2033 | −1725 | −2034 | −738 | 1178 | 1108 | −2310 | −1972 | 497 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 492(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 498 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 493(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 499 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 494(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 500 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 495(Y) | −866 | −976 | −1863 | −1331 | 1353 | −2145 | 1318 | −556 | −1116 | −777 | −173 | −1242 | −2197 | 1714 | −1301 | −1173 | −802 | 888 | −445 | 2749 | 501 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 496(D) | 417 | −1831 | 1647 | 1094 | −2065 | −1488 | −353 | −1618 | −107 | −1820 | −1019 | −189 | −1698 | 30 | −623 | −603 | −643 | 1629 | −2154 | −1520 | 502 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 497(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 503 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 498(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 504 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 499(T) | 492 | −1190 | −706 | −181 | −1475 | 311 | −333 | −1099 | −81 | 71 | −509 | 570 | 1113 | −6 | −509 | −450 | 1123 | −835 | −1680 | −1161 | 505 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 500(I) | −2091 | −1746 | −3971 | −3840 | −1676 | −3532 | −3289 | 3684 | −3581 | −659 | −693 | −3562 | −3674 | −3445 | −3521 | −3194 | −2146 | 449 | −2877 | −2493 | 506 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 501(A) | 3103 | −1036 | −2445 | −2572 | −3222 | 1051 | −2380 | −2930 | −2650 | −3226 | −2381 | −1739 | −2034 | −2327 | −2648 | −664 | −857 | −1981 | −3412 | −3228 | 507 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 502(L) | −2239 | −1892 | −3711 | −3400 | 301 | −3520 | −1210 | −542 | −2948 | 2564 | −35 | −2786 | −3395 | −2438 | −2750 | −2747 | −2165 | −945 | −573 | 2562 | 508 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 503(V) | −1757 | −1387 | −4101 | −3681 | −1174 | −3714 | −3031 | 880 | −3410 | 1254 | −60 | −3407 | −3585 | −3094 | −3354 | −2984 | −1743 | 3014 | −2536 | −2219 | 509 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 504(Q) | −982 | −2251 | −866 | 971 | −2711 | −1822 | −252 | −2340 | 1444 | −2194 | −1356 | −464 | −1885 | 2646 | 1632 | −858 | −863 | −1958 | −2245 | −1765 | 510 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 505(E) | −1162 | −2771 | 2137 | 2239 | −3046 | −1526 | −626 | −2849 | −546 | −2792 | −1983 | −145 | −1905 | −242 | −1192 | −940 | 1396 | −2385 | −2990 | −2169 | 511 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 506(G) | −1707 | −2684 | 1591 | −614 | −3783 | 3190 | −1613 | −3795 | −1887 | −3775 | −3119 | −915 | −2456 | −1358 | −2539 | −1610 | −1924 | −3150 | −3636 | −3124 | 512 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 507(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 513 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 508(M) | −473 | −522 | −1819 | −1236 | −468 | −1879 | −687 | 1519 | −996 | 566 | 1677 | −1154 | −1937 | 836 | −1131 | 1079 | −413 | 102 | −957 | −585 | 514 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 509(I) | −1761 | −1312 | −4317 | −3954 | −1713 | −4027 | −3703 | 3225 | −3814 | −556 | −498 | −3712 | −3859 | −3653 | −3877 | −3344 | −1754 | 2110 | −3216 | −2787 | 515 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 510(T) | 782 | −1467 | −550 | 1029 | −2202 | −1425 | −709 | −1791 | −472 | −1993 | −1203 | −528 | −1787 | −368 | −902 | −617 | 2685 | −1400 | −2333 | −1783 | 516 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 511(I) | −1766 | −1333 | −4283 | −3923 | −1635 | −3967 | −3619 | 3388 | −3759 | −473 | −437 | −3672 | −3822 | −3576 | −3804 | −3285 | −1764 | 1695 | −3126 | −2717 | 517 |

TABLE 8-continued

| | | | | | | | | | | | | | | | | | | | | | |
|---|---|---|---|---|---|---|---|---|---|---|---|---|---|---|---|---|---|---|---|---|---|
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 512(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 518 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 513(A) | 2705 | −1451 | −1036 | −913 | −2506 | −1504 | −1143 | −2174 | −794 | −2337 | −1613 | −946 | −1993 | 2040 | −1061 | −809 | −910 | −1703 | −2633 | −2156 | 519 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 514(H) | −615 | −1680 | 1444 | 66 | −1883 | 168 | 2650 | −1558 | −86 | −1691 | −891 | −223 | −1680 | 31 | −577 | −571 | −585 | 1267 | −2007 | −1397 | 520 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 515(K) | −654 | −2006 | −546 | 42 | −2376 | −1581 | −133 | −2066 | 1935 | −1987 | −1107 | 1132 | −1658 | 1043 | 1058 | −540 | 1180 | −1660 | −2113 | −1532 | 521 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 516(N) | −933 | −2085 | −946 | −284 | −2472 | −1822 | −253 | −2090 | 1711 | 76 | −1204 | 1918 | −1876 | 175 | 1799 | −841 | −817 | −1755 | −2132 | −1663 | 522 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 517(E) | −416 | −987 | −843 | 1107 | −1070 | −1583 | −338 | −623 | −183 | 879 | −172 | −489 | −1679 | −94 | −565 | 544 | 813 | 265 | −1379 | −905 | 523 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 518(I) | −2258 | −1804 | −4588 | −4084 | −706 | −4269 | −3231 | 2527 | −3807 | 2292 | 465 | −3923 | −3814 | −3118 | −3570 | −3544 | −2181 | 190 | −2303 | −2237 | 524 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 519(Q) | −477 | −1909 | 958 | 282 | −2211 | −1389 | 1484 | −1953 | 285 | −1921 | −1018 | −32 | −1517 | 2318 | −225 | 630 | 559 | −1525 | −2110 | −1430 | 525 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 520(L) | −2127 | −1743 | −4402 | −3796 | 1257 | −3918 | −2674 | 149 | −3492 | 2527 | 2164 | −3553 | −3509 | −2714 | −3181 | −3095 | −2019 | 570 | −1870 | −1818 | 526 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 521(N) | −723 | −2217 | 958 | 236 | −2518 | −1466 | 1611 | −2279 | 1719 | −2217 | −1334 | 2285 | −1666 | 166 | −401 | −570 | −677 | −1837 | −2382 | −1678 | 527 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 522(V) | −1754 | −1297 | −4330 | −3968 | −1770 | −4053 | −3752 | 2623 | −3841 | −620 | −545 | −3729 | −3878 | −3699 | −3918 | −3371 | −1746 | 2846 | −3277 | −2830 | 528 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 523(S) | 1545 | −974 | −2003 | −1825 | −2867 | −1206 | −1790 | −2580 | −1788 | −2795 | −1932 | −1362 | 1826 | −1586 | −1999 | 2362 | −672 | −1755 | −3057 | −2721 | 529 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 524(D) | −1776 | −3649 | 3326 | 1869 | −3838 | −1642 | −1031 | −3788 | −1322 | −3660 | −3029 | −245 | −2192 | −711 | −2201 | −1425 | −1855 | −3264 | −3821 | −2816 | 530 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 525(E) | 423 | −2950 | 1944 | 2696 | −3223 | −1545 | −718 | −3047 | −715 | −2979 | −2196 | −161 | −1968 | −347 | −1403 | −1043 | −1314 | −2569 | −3177 | −2316 | 531 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 526(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 532 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 527(L) | −2339 | −1899 | −4618 | −4042 | 1570 | −4204 | −2849 | 1440 | −3758 | 2558 | 676 | −3825 | −3700 | −2902 | −3418 | −3418 | −2226 | −382 | −1924 | −1778 | 533 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 528(A) | 2338 | −1990 | −241 | 938 | −2395 | −1557 | −423 | −2061 | 954 | −2103 | −1286 | −301 | −1791 | −26 | −375 | −717 | −784 | −1691 | −2330 | −1728 | 534 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 529(R) | 524 | −2098 | −789 | −146 | −2504 | −1729 | 1632 | −2153 | 1229 | −2054 | −1204 | −379 | −1789 | 1328 | 2313 | −719 | −724 | −1774 | −2150 | −1637 | 535 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 530(R) | −2957 | −3022 | −3318 | −2735 | −3796 | −2998 | −1968 | −3912 | −846 | −3631 | −3157 | −2611 | −3280 | −1724 | 4056 | −3026 | −2913 | −3650 | −3096 | −3185 | 536 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 531(R) | −1895 | −2713 | −2327 | −1192 | −3484 | −2502 | −481 | −2856 | 2144 | −2544 | −1842 | −1161 | −2458 | 1393 | 3023 | −1770 | −1619 | −2599 | −2421 | −2259 | 537 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 532(A) | 2935 | −1714 | −553 | 857 | −2769 | −1546 | −1218 | −2333 | −1106 | −2591 | −1873 | −809 | −2065 | −934 | −1502 | −954 | −1103 | −1872 | −2898 | −2374 | 538 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 533(A) | 1291 | −1874 | −176 | 1227 | −2177 | −1392 | −109 | −1909 | 277 | −1891 | −995 | 1134 | −1522 | 1248 | −228 | −361 | 562 | −1492 | −2090 | −1419 | 539 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 534(W) | −805 | −687 | −2581 | −2028 | 138 | −2236 | −697 | 897 | −1681 | −421 | 141 | −1645 | −2282 | −1369 | −1627 | −1315 | 636 | −90 | 4479 | 1809 | 540 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 535(H) | −408 | −1801 | −274 | 1284 | −2096 | −1385 | 1500 | −1822 | 1168 | −1802 | −899 | −33 | −1479 | 1381 | −102 | −303 | 595 | 221 | −1996 | −1339 | 541 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 536(Q) | −650 | −1737 | −627 | −72 | −1981 | −1615 | −209 | −1625 | 1223 | 392 | −866 | −318 | 1222 | 2120 | 50 | −598 | −572 | −1326 | −1932 | −1394 | 542 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 537(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 543 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −324 | −7108 | −2368 | −894 | −1115 | −701 | −1378 | * | * | | | | | | | | | | | | |
| 538(A) | 2195 | −924 | −968 | −546 | −1397 | −1356 | −583 | −812 | −365 | −1167 | −487 | −618 | −1660 | 1324 | −684 | −483 | −404 | 462 | −1703 | −1242 | 544 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −19 | −6804 | −7846 | −894 | −1115 | −428 | −1961 | * | * | | | | | | | | | | | | |
| 539(P) | 411 | −1017 | −1886 | −1616 | −1600 | −1588 | −1411 | −962 | −1408 | 495 | −755 | −1384 | 3156 | −1323 | −1577 | −847 | −785 | −783 | −2111 | −1716 | 545 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 540(R) | −1612 | −2397 | −2037 | −1033 | −2897 | −2352 | −458 | −2365 | 2184 | 665 | −1520 | −1051 | −2334 | −51 | 2602 | −1545 | −1395 | −2143 | −2262 | −2014 | 546 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 541(Y) | 712 | −796 | −2334 | −1883 | −370 | −2028 | −986 | −143 | −1607 | −663 | −131 | −1587 | −2243 | −1383 | −1656 | −1178 | −771 | 1114 | −965 | 3479 | 547 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 542(T) | −527 | −1669 | 1091 | −27 | −2315 | −1379 | −443 | −2033 | −151 | −2081 | −1218 | −282 | 557 | −41 | −650 | 1128 | 2077 | −1576 | −2321 | −1690 | 548 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 543(R) | −2957 | −3022 | −3318 | −2735 | −3796 | −2998 | −1968 | −3912 | −846 | −3631 | −3157 | −2611 | −3280 | −1724 | 4056 | −3026 | −2913 | −3650 | −3096 | −3185 | 549 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 544(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 550 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 545(V) | −1747 | −1296 | −4310 | −3948 | −1758 | −4023 | −3716 | 2215 | −3813 | −615 | −540 | −3705 | −3860 | −3670 | −3887 | −3339 | −1741 | 3087 | −3252 | −2806 | 551 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 546(L) | −2871 | −2457 | −4231 | −4103 | −1033 | −3803 | −3165 | −541 | −3734 | 3130 | −31 | −3935 | −3797 | −3286 | −3484 | −3713 | −2869 | −1136 | −2394 | −2220 | 552 |
| — | −149 | −500 | 233 | 43 | −381 | 399 | 106 | −626 | 210 | −466 | −720 | 275 | 394 | 45 | 96 | 359 | 117 | −369 | −294 | −249 | |

TABLE 8-continued

| | | | | | | | | | | | | | | | | | | | | | |
|---|---|---|---|---|---|---|---|---|---|---|---|---|---|---|---|---|---|---|---|---|---|
| — | −16 | −7108 | −8150 | −894 | −1115 | −701 | −1378 | * | * | | | | | | | | | | | | |
| 547(A) | 2404 | −890 | −1926 | −1629 | −1803 | 1275 | −1415 | −1282 | −1490 | 392 | −963 | −1316 | −1930 | −1328 | −1674 | −654 | −644 | −952 | −2187 | −1810 | 553 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 548(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 554 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 549(Y) | −3621 | −2707 | −4176 | −4424 | 2950 | −4049 | −394 | −2539 | −4002 | −1942 | −1987 | −2749 | −3933 | −2854 | −3451 | −3299 | −3499 | −2690 | 349 | 4094 | 555 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 550(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 556 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 551(H) | −1741 | −2627 | −2070 | −1046 | −3303 | −2401 | 2713 | −2751 | 2478 | −2476 | −1755 | −1061 | −2375 | −27 | 2379 | −1621 | −1497 | −2477 | −2379 | −2161 | 557 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 552(L) | −1014 | −876 | −2956 | −2408 | −582 | −2550 | −1529 | 1721 | −2079 | 2042 | 345 | −2114 | −2581 | −1775 | −2028 | 454 | −980 | 286 | −1414 | −1096 | 558 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 553(V) | 933 | −842 | −2818 | −2467 | −1542 | −1870 | −1890 | 154 | −2226 | −1095 | −617 | −1932 | −2326 | −1995 | −2259 | −1126 | 1070 | 2769 | −2180 | −1826 | 559 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 554(S) | −787 | −1522 | −1486 | −1172 | −2714 | −1599 | −1112 | −2500 | −433 | −2563 | −1791 | −1110 | −2067 | −796 | 1351 | 2916 | −989 | −1943 | −2648 | −2234 | 560 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 555(S) | −326 | −1010 | −1779 | −1541 | −2691 | −1234 | −1566 | −2386 | −1486 | −2594 | −1749 | −1228 | 1196 | −1330 | −1747 | 2396 | 1967 | −1662 | −2876 | −2496 | 561 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 556(A) | 3121 | −934 | −2489 | −2561 | −3081 | −1203 | −2295 | −2766 | −2533 | −3080 | −2234 | −1669 | −1953 | −2234 | −2533 | 936 | −746 | −1844 | −3331 | −3090 | 562 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 557(S) | −897 | −1462 | −2333 | −2543 | −3185 | −1640 | −2474 | −3294 | −2686 | −3497 | −2780 | −1973 | −2360 | −2483 | −2703 | 3465 | −1316 | −2413 | −3310 | −3025 | 563 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 558(R) | −586 | −1873 | −516 | 979 | −2188 | −1543 | −123 | −1869 | 1290 | −353 | −980 | −202 | −1622 | 314 | 1886 | −491 | 782 | −1495 | −2024 | −1439 | 564 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 559(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 565 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 560(C) | 2804 | 3772 | −3185 | −3198 | −2739 | −1303 | −2462 | −2065 | −2882 | −2628 | −1924 | −1927 | −2044 | −2547 | −2727 | −661 | −799 | −1463 | −3099 | −2886 | 566 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 561(V) | −1771 | −1603 | −3750 | −3689 | −2037 | −3050 | −3231 | 403 | −3479 | −1154 | −1076 | −3246 | −3399 | −3383 | −3437 | −2628 | −1917 | 3536 | −3074 | −2677 | 567 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 562(T) | −1213 | −1674 | −2755 | −2906 | −3163 | −1922 | −2659 | −2698 | −2788 | −3105 | −2612 | −2311 | −2600 | −2708 | −2753 | −1463 | 3819 | −2197 | −3286 | −3156 | 568 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 563(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 569 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −21 | −6715 | −7757 | −894 | −1115 | −701 | −1378 | * | * | | | | | | | | | | | | |
| 564(F) | −525 | −445 | −2202 | −1627 | 1946 | −2001 | −744 | 1247 | −1346 | 952 | 561 | 1079 | −2030 | −1067 | −1362 | −1067 | −465 | 338 | −714 | −230 | 570 |

TABLE 8-continued

— * * * * * * * * * * * * * * * * * * * *
— * * * * * * * * 0

| Entry | Description |
| --- | --- |
| HMMER2.0 [2.2g] | Program name and version |
| NAME dhad__for__hmm | Name of the input sequence alignment file |
| LENG 564 | Length of the alignment: include indels |
| ALPH Amino | Type of residues |
| MAP yes | Map of the match states to the columns of the alignment |
| COM/app/public/hmmer/current/bin/hmmbuild -F dhad-exp__hmm dhad__for__hmm.aln | Commands used to generate the file: this one means that hmmbuild (default patrameters) was applied to the alignment file |
| COM/app/public/hmmer/current/bin/hmmcalibrate dhad-exp__hmm | Commands used to generate the file: this one means that hmmcalibrate (default parametrs) was applied to the hmm profile |
| NSEQ 8 | Number of sequences in the alignment file |
| DATE Tue Jun 3 10:48:24 2008 | When was the file generated |
| XT −8455 −4 −1000 −1000 −8455 −4 −8455 −4 | |
| NULT −4 −8455 | The transition probability distribution for the null model (single G state). |
| NULE 595 −1558 85 338 −294 453 −1158 197 249 902 −1085 −142 −21 −313 45 531 201 384 −199 | The symbol emission probability distribution for the null model (G state); consists of K (e.g. 4 or 20) integers. The null probability used to convert these back to model probabilities is 1/K. |
| EVD −499.650970 0.086142 | The extreme value distribution parameters μ and lambda respectively; both floating point values. Lambda is positive and nonzero. These values are set when the model is calibrated with hmmcalibrate. |

SEQUENCE LISTING (753 sequences)

SEQ ID NO: 1 - DNA, 1731 bp, Saccharomyces cerevisiae
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgttactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 2 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKIIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 3 - protein, 600 aa, Schizosaccharomyces pombe
MTGTSFYTSVLRLGRLAQQGLKFQSVKHIRPSCFSSFGLQAKRWNSTQQNDSSIDCLEPKLQGIIEDNISPSTAQKEISDIKFNIPKEMLLPDGTPDYLRLTLTSNVYEVIKETPLTKGVVISESTGVPVYLKREDLTPVFSFKIRGAHNKMASLDKQSLKNGVIACSAGNHAQGVAYSARTLGVKATIVMPQNTPEIKWRNVKRLGANVLLHGANFDIAKAECARLAKEQNLEVIHPFDDPYVIAGQGTIGLEILHQIDLRKLDAIYCAVGGGGLIAGIATYVKRIAPHVKVIGVETFDADALKKSLKDKKRVTLKEVGLFADGTAVKLVGEETFRLVSKNIDDVVLVDKDEICAAIKDVFLDTRSVVEPSGAMAVAGMKRYVAKHKPKNPNAAQVCILSGANMDFDRLRFIAERADLGLNKEVFLSVTIPERPGSFEALHNIITPRSITEFSYRYDNDDYANIYTSFVVKDRATELPLILQQISEQNMVAEDISDNELAKTHARYLIGGKSSVSKERLYRLDFPERPGALCKFLRSIKEVCSISLFHYRNCGGDIASVLAGLRVFDGQVEKLHSVLEEIGYNWVDETNNPVYLRYLRK

SEQ ID NO: 4 - DNA, 1710 bp, Candida albicans
atgtcaatcactcgactttcaagtgctaagcttttattaagtagcacgtcacgcaaactacaggtattaaggttaaatagtacaacgaccaaaccccttacccctagacaaaaatggccggaacttttggactctgatttcatagtgaattctcaaggtgaaaaacaacccgattatgtcaaattgatattaacttcaagagtgtacgatgttgtggacgaagccggtacaccattaaccaatgctatcaatttatctcatagatgtggtgccaatatctatcttaaaagagaggatttgttaccagttttttcgttcaagttgagaggtgcatataatatgattgcccatttgcattcaaattccccacaacctatatcaggggttattgcttgttcggcaggaaaccatgcccaaggagttgcattttcttcgagtaaattaaatatcccagccacaattgtcatgcctactccaacaccttctatcaagtacaccaatgtttcaagattaggtgcccaagttgtattgtatggagacgattttgattcagcaaaacaagagtgtgaaaggttgagcacagagcaaaatttaatcaacattccaccttttaaccatccttacgttattgctggtcagggtacaattgctttagagattgctagacaattgagattagataaattgaatgccatatttgttcctgtaggaggaggtggcttaattgcaggtgtggcagtgtatttgaagcatattgcccctcacgtcaaaatcataggagtagaaacgtatgatgccgatgcattgaaccagtctttaaagaatagtcgcctggttactttggaaaaagttggtttgtttgcagatggtactgccgtgaaagttcttggagatgaaacctggagattagcaaaagaatatgtagatgaagttgtgcttgtcaacactgatgaattgtgtgctgctattaaggatatttttgaagacacaaggctgattgtcgaaccttctggagcattgtctgttgctggattgaaaaagtacattgaagaacacccagagattgaccacagagataagacatatgttccagttttgtctggtgctaatatgaattttgatagattaaggtttgttagtgaaagagcagttttgggtgaaggaaaagaagtctcattggctgttaccattcctgagaaacctggtgagtttgccagattgcaaaaagttatcaatccacgtgctatcactgaattttcatacaggtacaacggtgaagaaaacgccgatatatttgtgtcctttaatgtagtggacaagaaaaaagaaaagtcttcagttatagcagcaatggaaaattgtggatttgaagttgttgatatttcagaaaacgaattggcaaaatctcatggacgttatttagttggtggtaagtcacaatctacaaaatcctcaaatgaaaaaatctatcaatttgaattccctgaaaaaccaaatgctttgtttaactttttacaagcattaaggagcgactggaatatcagcttgtttaattatagaaatcatggacatgatgtcggaaaaatcttgtgtgcatttactcttcctgaaggatctgaggaagacttccaagaatttttaaagaatgttggttacacttttgttgatgaatctgataacatcttttacaaaaaattcttgagaagctaa

SEQ ID NO: 5 - protein, 569 aa, Candida albicans
MSITRLSSAKLLLSSTSRKLQVLRLNSTTTKPLTPRQKWPELLDSDFIVNSQGEKQPDYVKLILTSRVYDVVDEAGTPLTNAINLSHRCGANIYLKREDLLPVFSFKLRGAYNMIAHLHSNSPQPISGVIACSAGNHAQGVAFSSSKLNIPATIVMPTPTPSIKYTNVSRLGAQVVLYGDDFDSAKQECERLSTEQNLINIPPFNHPYVIAGQGTIALEIARQLRLDKLNAIFVPVGGGGLIAGVAVYLKHIAPHVKIIGVETYDADALNQSLKNSRSVTLEKVGLFADGTAVKVLGDETWRLAKEYVDEVVLVNTDELCAAIKDIFEDTRSIVEPSGALSVAGLKKYIEEHPEIDHRDKTYVPVLSGANMNFDRLRFVSERAVLGEGKEVSLAVTIPEKPGEFARLQKVINPRAITEFSYRYNGEENADIFVSFNVVDKKKEKSSVIAAMENCGFEVVDISENELAKSHGRYLVGGKSQSTKSSNEKIYQFEFPEKPNALFNFLQALRSDWNISLFNYRNHGHDVGKILCAFTLPEGSEEDFQEFLKNVGYTFVDESDNIFYKKFLRS

SEQ ID NO: 6 - DNA, 1716 bp, Candida glabrata
atgatacccaagctgctgtgtggtaacacactgttgagtgcatctgttacaacaagtaggtctgtctatggcttatctaccagatattttactcaggatctcgcaccttcattggttaaactgcattccgagttaaagcctgatgagcttcttactgataacacaccagactatgtgcgtttggtgctaagatcatcggtctatgatgttataaaggaatcgccaatctcacatggtgttggtctatcgtctagactaaacacaaatgtccaactgaaaagagaagatttactaccagtgttctctttcaagctgcgtggtgcatacaacatgatagcgaagttagacgatactcagagaaatcaaggtgtcatcgcatgttccgcaggtaatcatgcacaaggtgtagcatatgccgctagacatttggatattccagcaactattgtcatgcctgtgtctactccatctataaaatatcaaaatgtgtcgagactgggttcacaagttgttctatatggtaatgattttgacgaagctaaagctgaatgtactaaactggcagaagagcgtggtttgactaacatccctccatttgatcatccatatgtcattgctggtcaaggaacagttgcgatggaaatcttgagacaggtctataactcaaataagatcggtgctgtctttgttccagttggtggtggtgggttgattgccggtgttggtgcctatttgaagagagtcactccacacatcaagattataggtgtggaaacacatgatgcagcaactttacacacatctcttcaaagaaataaaagaacaaatctagctagcgttggtacttttgctgatggtacttctgtgcgtattattggtgaagaaacctttagagttgccagagaagttgtcgatgaaattgtattggtcaatactgatgaaatttgtgctgcggttaaggatgtctttgaggataccagaagtattgttgaaccatctggtgctcttgcggttgctggtatgaagaagtatattactcaacttcatccagaaatagatcactctaagcaaacatatgtcccaattttgtcaggtgctaatatgaacttcgatagattaagatttgtttctgagcgtgctgtattaggtgaaggtaaggaagtttttatgctggttaccattcctgacgttccaggctctttcaaaaaaatgcagaaggttattcatccaagagctgttactgagttctgttaccgttataatgaacatcgtcatgaatcttctagtgaggttccaaaggcctatatctatacatctttcagtgtggtagaccgcgaaaaggagattaaacaagtaatgcagcaactgaacaccctcggttttgaagccgtcgatatttctgacaatgaattagcaaaatcacatggtagatatttagttggtggtgcgtcaaaggtcccaaatgaaagaattatttcgttcgaattcccagaaagacctggggccttaaccagattcttggcaggtttaagcgagtcttggaatttgacattgttccattacagaaaccatggtgctgatattggtaaagtattggctggtatttctgtgccacctagagaaaatttaactttccaaaaattcttggaagatttaggctataagtaccaagatgaaacagaaaatatggtatatcaaagactactgaaatattaa

SEQ ID NO: 7 - protein, 571 aa, Candida glabrata
MIPKLLCGNTLLSASVTTSRSVYGLSTRYFTQDLAPSLVKLHSELKPDELLTDNTPDYVRLVLRSSVYDVIKESPISHGVGLSSRLNTNVQLKREDLLPVFSFKLRGAYNMIAKLDDTQRNQGVIACSAGNHAQGVAYAARHLDIPATIVMPVSTPSIKYQNVSRLGSQVVLYGNDFDEAKAECTKLAEERGLTNIPPFDHPYVIAGQGTVAMEILRQVYNSNKIGAVFVPVGGGGLIAGVGAYLKRVTPHIKIIGVETHDAATLHTSLQRNKRTNLASVGTFADGTSVRIIGEETFRVAREVVDEIVLVNTDEICAAVKDVFEDTRSIVEPSGALAVAGMKKYITQLHPEIDHSKQTYVPILSGANMNFDRLRFVSERAVLGEGKEVFMLVTIPDVPGSFKKMQKVIHPRAVTEFCYRYNEHRHESSSEVPKAYIYTSFSVVDREKEIKQVMQQLNTLGFEAVDISDNELAKSHGRYLVGGASKVPNERIISFEFPERPGALTRFLAGLSESWNLTLFHYRNHGADIGKVLAGISVPPRENLTFQKFLEDLGYKYQDETENMVYQRLLKY

SEQ ID NO: 8 - DNA, 1704 bp, Kluyveromyces lactis
atgctacaatctatagtgagaactcctagagttcttcgtgcttcaaatgcattaaaactttctgttcgctgtgttagcacggaccagttctctgataatttgcagaggatgtactcccatttgaaggctgacgaacgattggaagatggatctccagactacgtgcgtttaattttaaggtcttctgtttatgaagtcattgaagagacccccatttcacgtgcggtgtcattgtcctctagactaaacactaacgttaaattgaaaagagaggatttgttgccagtgttttccttcaagctgcgtggtgcttataacatgattgccaagctagacgaaacacagaagaatgctggtgttattgcgtgctctgctggtaatcacgcacaaggtgttgccttttcaagtaatcatatgaacattccagctaccattgtgatgcctgtttcaacaccatcaatcaaatatcaaaacgtgtcgagattaggtgcccaagtggttctatacggtgacgacttcgatgaagccaaattggaatgtgcgaggttagctgaagaacgtggtatgacagatattccaccatttgatcatccttacgttatcgctggtcaaggtactattgccatggagattctaagacaagtacaaaatgggtctaacatcggagcagtgttctgtgccgtaggtggtggtggtttgatttcaggtattggttcatacttgaagagaatcgcacctcatatcaaggttattggtgtggaaacttacgatgccgctacgttagatgtttcattaaagaacggtaaacgtaccccattgccaagtgttggaacgttcgctgatggtacctctgtgaggttaatcggtgaagaaacattccgtgtttgtcaagacgtagtcgatgaagttatcttggtgaacaccgatgaaatctgtgctgccgttaaagatgtgtttgaggacacaagatcaattgtcgaaccaagtggtgctcttgctgttgccggtttgaaaaaatatgtctctcaactacaccctgaaatagaccattctaagaagacatacgttccaattctttccggtgccaacatgaatttcgaccgtttaagattcgtctcagaacgtgctgtattgggtgaaggtaaagaagtgtttatgttggtcaccattccagatactccaggttctttcaagaagctacagaatgtgatccatccaagagctgtcactgaattctcataccgttataacgagcattgtcacgaaaatgactccgatgtaccaaccgcttgtatctacacatcttttaacgtcgttgaccgtgaaaaggaaatcaagcaagtggttcaacaattgcatgctttaggtttcgaagccgtagatatctctgacaacgaaatggccaagtctcacggtagatatttggtcggtggtgcttctaaaattgaaaatgagaaagtcattgcattcgaattcccagagagaccaggtgcactaactaaattcttatcaggattgaacgtttcctggaacttgactttattccattacagaaaccatggcgctgatattgggaaaattttggctggtatcagtgtgcctccacaagacaacgaaatcttccaaaagttcttggacgatctaggatataaatatcaagatgaaactgacaatatggtttaccagaagtttttgaagtactag

SEQ ID NO: 9 - protein, 567 aa, Kluyveromyces lactis
MLQSIVRTPRVLRASNALKLSVRCVSTDQFSDNLQRMYSHLKADERLEDGSPDYVRLILRSSVYEVIEETPISRAVSLSSRLNTNVKLKREDLLPVFSFKLRGAYNMIAKLDETQKNAGVIACSAGNHAQGVAFSSNHMNIPATIVMPVSTPSIKYQNVSRLGAQVVLYGDDFDEAKLECARLAEERGMTDIPPFDHPYVIAGQGTIAMEILRQVQNGSNIGAVFCAVGGGGLISGIGSYLKRIAPHIKVIGVETYDAATLDVSLKNGKRTPLPSVGTFADGTSVRLIGEETFRVCQDVVDEVILVNTDEICAAVKDVFEDTRSIVEPSGALAVAGLKKYVSQLHPEIDHSKKTYVPILSGANMNFDRLRFVSERAVLGEGKEVFMLVTIPDTPGSFKKLQNVIHPRAVTEFSYRYNEHCHENDSDVPTACIYTSFNVVDREKEIKQVVQQLHALGFEAVDISDNEMAKSHGRYLVGGASKIENEKVIAFEFPERPGALTKFLSGLNVSWNLTLFHYRNHGADIGKILAGISVPPQDNEIFQKFLDDLGYKYQDETDNMVYQKFLKY

SEQ ID NO: 10 - DNA, 1590 bp, Yarrowia lipolytica
atgtccgaacccgactatctgaagctcatcttgaagagccgcgtctacgacgtgtgcaaggaaacacctgtgacatctgctcatggtctgagcgagaagctgggctgcaaagtgctgctcaagcgggaagatcttcagccggttttctcgttcaagctgcgaggagcctacaacatgatttcgcagctgagtgacgaggaaaagtggaagggagtgattgcgtgtagcgccggtaaccatgcccaaggagtcgccttttcagccaactatctcaacattccagcgactattgtcatgccgttggccactccttccatcaagcacagtaatgtttctagactaggtggcaaggtggttttgcacggagacgattttgattcggccaaggcccactgcaagcagctgtgtgagaaatatggactcacagatatccctccctttgatcacccccacgtgattgcaggccagggaactattggtatggagattcttcgtcaggcgtcggacaacctgaaggccgtgtttatctgtgttggaggcggcggtctgattgccggagtaggcgcttacatcaagcggatccagcccgatgtcaaaatcattgccgtggagacctatgatgcatgtgctctgaaacagagtctcatcaagggcgaacgggtgactctgcctgaagtcggtctgtttgccgatggagctgctgtcaagctgtgtggcgaggagactttccgactctgtcgcaagtacgttgatggagttgtgcttgtgaacacggacgagatctgcgccgctatcaaagatgtatttgaggccactagatcggtggtggagcctgctggtgctctgtcggtggctggtctcaagaagtactgctccgacccctcggccatttggtggtcacctgagtccgattccgcaaaggccaatggtatccccactaacgttgccatctcagaaaccgacgagtatctgtcaattctctctggagccaacatgaactttgaccggcttcgattcgtggccgaacgagctatgcttggagaaggaaccgaagtcttcatggtcgtcaccatccccgatattcccggagcgtttgaaaagctgcacgagatcattctccccagagctgtcaccgagttctcctacagaaagaagtccactgctgagaacgaagacgctaacatttttgtgtctttttcagtcaaaaaccgacaagaggaaattgcagacgtgctggaaaagctgcaagctgccggtatgagcggagtcgacgtttcagacaacgaactggcaaagacccacgctagatatctcgtgggaggccagccagacgtgcctaatgagagactgttccggttcgagttccctgaacgacccaacgcgctcaaaaacttcctcggaggtgtccagacaaagtggaatatcaccctgttccactacagaaacaacggcagtgatattggaaagattctgacagccttggacgtgccggaaagcgacaatgaggcgctcaaggagtttcttgagaagctcaagtacccctttgtggaggagacagacaatgtggtgtacaagcagtttatgaagtaa

SEQ ID NO: 11 - protein, 529 aa, Yarrowia lipolytica
MSEPDYLKLILKSRVYDVCKETPVTSAHGLSEKLGCKVLLKREDLQPVFSFKLRGAYNMISQLSDEEKWKGVIACSAGNHAQGVAFSANYLNIPATIVMPLATPSIKHSNVSRLGGKVVLHGDDFDSAKAHCKQLCEKYGLTDIPPFDHPHVIAGQGTIGMEILRQASDNLKAVFICVGGGGLIAGVGAYIKRIQPDVKIIAVETYDACALKQSLIKGERVTLPEVGLFADGAAVKLCGEETFRLCRKYVDGVVLVNTDEICAAIKDVFEATRSVVEPAGALSVAGLKKYCSDPSAIWWSPESDSAKANGIPTNVAISETDEYLSILSGANMNFDRLRFVAERAMLGEGTEVFMVVTIPDIPGAFEKLHEIILPRAVTEFSYRKKSTAENEDANIFVSFSVKNRQEEIADVLEKLQAAGMSGVDVSDNELAKTHARYLVGGQPDVPNERLFRFEFPERPNALKNFLGGVQTKWNITLFHYRNNGSDIGKILTALDVPESDNEALKEFLEKLKYPFVEETDNVVYKQFMK

SEQ ID NO: 12 - DNA, 1620 bp, Pichia stipitis
atgtttttcagtagatctggagaagttgaaaaatttccaaaccttctcgacgccgatttcaacgaagatggtgatccagactacatcaaattgatcttgacttcacgagtgtatgatgttgtggaaagggcaggaacccctctcacacatgccatcaatttgtcccataagtgcaattcaaacatctacttgaagagagaggatttgcttcctgtattctctttcaaattgcgtggagcatataatatgatttcacatttgcattctaactcaaagatgccactttcgggtgtaatagcttgttctgctggtaaccatgctcaaggtgtagcttactctgccaacagattgaaaattccttccactatagttatgcctacggctacaccttctatcaagtataccaatgtttcgagacttggatcgcaagttgttttgtatggtgacgactttgactcggccaagcaagaatgtgcccgtttgagttcattgaacaacttgacggatgtgcctcctttcgaccatccctatgtcatcgctggccagggtaccatagcattggagatcacgagacagttgcgcttggataagttgaacgcattgtttgtccctgttggtggtggtggtcttattgctggtgtcgctgtctacttgaagaagattgctccccatgtgaagatcattggtgtagaaacaaacgatgctgatgccttgtaccagtcgctcaaggctaaaaagctggtggtacttgaccaagttggtatgtttgctgacggaactgctgtcaaggtcttaggtaaagaaacctggagactctgtgaaaacttagtagacgaagtcgttaaggtttctactgatgagttgtgtgcagcaatcaaggatatctttgaagacacaagactgattactgaaccatccggagccttgtctgtagccggcttgaagaagtacattgaacaaaatccagacattgaccacagaaacaagttctatgtgcccatcttgagtggtgccaatatgaacttcgacagattgagattcgtcagcgagagagctgttctcggtgaaggtaaagaagtttcgttggtggttactattcctgaaaagcctggtgaattcgccaagttgcaaagtatcatcaatcctagagccattacagaattctcgtacaggtgtaatggtgctgatgccaacatctttgtttccttcaatgttattgacaaaaagaaggaattaaccccaattattgaagacatgaacaacaatgaacatggatacgaagtagttgatatctctgacaatgaattagccaagacccatggtcgttatttggtcggcggtaagtcctctgaagaagttgccaatgaaagattatacagtttcgaatttccagaaaagcctggagccttattcaacttcttacaagctttgaaggctgattggaacattactttgtttcattacagaaatcacgggcacgacatcggcaaggttttgtgtggttttacgcttcctgaaggaacagatgacgcagatttccagtccttcttgaatgaacttggatacaagttcaatgttgaaaatgacaacgttgtctataagaagttcttgagaagctga

SEQ ID NO: 13 - protein, 539 aa, Pichia stipitis
MFFSRSGEVEKFPNLLDADFNEDGDPDYIKLILTSRVYDVVERAGTPLTHAINLSHKCNSNIYLKREDLLPVFSFKLRGAYNMISHLHSNSKMPLSGVIACSAGNHAQGVAYSANRLKIPSTIVMPTATPSIKYTNVSRLGSQVVLYGDDFDSAKQECARLSSLNNLTDVPPFDHPYVIAGQGTIALEITRQLRLDKLNALFVPVGGGGLIAGVAVYLKKIAPHVKIIGVETNDADALYQSLKAKKSVVLDQVGMFADGTAVKVLGKETWRLCENLVDEVVKVSTDELCAAIKDIFEDTRSITEPSGALSVAGLKKYIEQNPDIDHRNKFYVPILSGANMNFDRLRFVSERAVLGEGKEVSLVVTIPEKPGEFAKLQSIINPRAITEFSYRCNGADANIFVSFNVIDKKKELTPIIEDMNNNEHGYEVVDISDNELAKTHGRYLVGGKSSEEVANERLYSFEFPEKPGALFNFLQALKADWNITLFHYRNHGHDIGKVLCGFTLPEGTDDADFQSFLNELGYKFNVENDNVVYKKFLRS

SEQ ID NO: 14 - DNA, 1182 bp, Saccharomyces cerevisiae
atgttgcagagacattccttgaagttggggaaattctccatcagaacactcgctactggtgccccattagatgcatccaaactaaaaattactagaaacccaaatccatccaagccaagaccaaatgaagaattagtgttcggccagacattcaccgatcatatgttgaccattccttggtcagccaaagaagggtggggcactccacacatcaagccttacggtaatctttctcttgacccatctgcttgtgtattccattatgcatttgaattatttgaaggtttgaaagcctacagaactcctcaaaatactatcaccatgttccgtccggataagaacatggcccgtatgaacaagtctgccgctagaatttgtttgccaactttcgaatctgaagaattgatcaaacttaccgggaaattgatcgaacaagataaacacttggttcctcaaggtaatggttactcattatacatcagaccaacaatgattggtacatccaagggtttaggtgttggcactccctccgaggctcttctttatgttattacttctccagtcggtccttattataagactggtttcaaagccgtacgtcttgaagcaacagactatgctacaagagcttggccaggtggtgttggcgacaaaaaattgggtgctaactatgccccatgcatcttacctcaactacaagctgccaaaagagggtaccaacaaaatctatggttgttcggcccagaaaagaacatcactgaggttggtactatgaacgtgttcttcgttttcctcaacaaagtcactggcaagaaggaattggttaccgctccattagatggtaccattttagaaggtgttaccagagactctgttttaacattggctcgtgacaaactagatcctcaagaatgggacatcaacgagcgttattacactattactgaagtcgccactagagcaaaacaaggtgaactattagaagccttcggttctggtactgctgctgtcgtttcacctatcaaggaaattggctggaacaacgaagatattcatgttccactattgcctggtgaacaatgtggtgcattgaccaagcaagttgctcaatggattgctgatatccaatacggtagagtcaattatggtaactggtcaaaaactgttgccgacttgaactaa

SEQ ID NO: 15 - protein, 393 aa, Saccharomyces cerevisiae
MLQRHSLKLGKFSIRTLATGAPLDASKLKITRNPNPSKPRPNEELVFGQTFTDHMLTIPWSAKEGWGTPHIKPYGNLSLDPSACVFHYAFELFEGLKAYRTPQNTITMFRPDKNMARMNKSAARICLPTFESEELIKLTGKLIEQDKHLVPQGNGYSLYIRPTMIGTSKGLGVGTPSEALLYVITSPVGPYYKTGFKAVRLEATDYATRAWPGGVGDKKLGANYAPCILPQLQAAKRGYQQNLWLFGPEKNITEVGTMNVFFVFLNKVTGKKELVTAPLDGTILEGVTRDSVLTLARDKLDPQEWDINERYYTITEVATRAKQGELLEAFGSGTAAVVSPIKEIGWNNEDIHVPLLPGEQCGALTKQVAQWIADIQYGRVNYGNWSKTVADLN

SEQ ID NO: 16 - DNA, 1143 bp, Schizosaccharomyces pombe
atggttcaaactgctgctctccatggcccaaagcccatggatagctcccatataaaagttactaatgttaaggagcttaaacctttgcccgaatggaagagtttgaagtttggtgagaattttactgatcatatgcttattatgaaatggaacagagaaaagggttggagtactcctgagatcgttccatttggtaaactttgctttcaccctgcttcctccgttttccattatggttttgagtgctttgaaggcatgaaagctttccgtgacgaaaagggtgtcccacgtcttttccgtcccatcaagaatgctgagcgtatgctttcaactggtactcgtatatctcttccttccttcgaccctgctgagcttgctgaaattatcagaaagttcgtcgctcacgaaaaccgttgggtccctgatcagcgtggttactctttgtacattcgtcctactttcattggtactgatgaagccttaggtgtccaccattgtgacaacgctatgctttatgttattgcctctcccgttggcccctactacagctctggtttcaaggccgttaagctttgttgctccgaagaatccgttcgtgcttggcctggcggtactggtcactacaagcttggtggtaactatgctcctagtgttttgcctcaaaaagaggctgccaagaaggggtatgctcagattctctggctttatggagacgaggactacattactgaggttggtactatgaactgctttactgtttggattaacaagaatggcgaaaaagaaatcattactgcccctcttgacggtatgatcttacctggtgtcactcgtgattctattttggaaatttgccgtgaacgtctcgcacctaaaggctggaagattactgagggcaagtattccatgaaagaggttgctcaagcttctaaggaaggtcgccttttggaagtctttggagctggtactgctgcccttgtttcccccgtcaaggctattaactacaagggtactgagtatgaaattcccatgcctgagggtcaggaagctggtcccatcacttctgaaatcagcaaatggattttggatatccaatacggcaaggaacctaacaacccttggagcgttcctgctttgccttaa

SEQ ID NO: 17 - protein, 380 aa, Schizosaccharomyces pombe
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKAVKLCCSEESVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 18 - DNA, 1110 bp, Candida albicans
atgtcagctccattagacgccagtaaattggaaatcactaaaactaccaaaccaagtgaaccattaccaaaagaagaattggttttcggtaaatcattcactgaccatatcttagaagttgaatggactgctgaaaaaggatggggtgttccaactattaaaccataccacaacttttcccttgatccagccacctgtgttttacattattcttttgagttatttgaaggtttaaaggcataccgtgatagcaatggtaaaatcagaacttttagaccagacaaaaatatggaaagaatgaatagatcagctaaaagagctgcattacctacatttgatggtgaagaatttatcaaattagttgatcaatttttgttgattgaagaaagatttgttccaactggttacggatattcactttacttgagaccaactttaattggtacttcaattgggttaggtgtcagtgcaccaactaaagcattattatatcttattgcttcacctgttggtccatatttcagtggtggtttcaaaccagtgtctttggaagccacagattacgccgtaagagcttggccaaaaggtgttggttcttataaattgggtgcaaactatgtgtcttgtattgaaccacaaatggaagctgccaagagaggtcattcccaaaatttgtggttatttggtgaagaaggttatattactgaagtgggtgctatgaatgttttttttgcattcaagaatgccgatggcactaaagaattggtgactccgccattggatggtatgatcttgccaggtgtcactcgtgattctactttagaattggctaaaagcaaattaccaagtgattggactgtcaatgaaagaaaattgactattcatgaagttaaagaaagagctgctaaaggtgaattagttgaagctttcggtactggtaccgctgctattgtttcaccaattgacaacattgaattccaaggcgaacaaattaaggttccagtttctgctggtagttccggagaaatagctttgaagatcaatgattggataaaggctattcaatatggtgatgaaagttttaaaaactggtctagagtagcccaatag

SEQ ID NO: 19 - protein, 369 aa, Candida albicans
MSAPLDASKLEITKTTKPSEPLPKEELVFGKSFTDHILEVEWTAEKGWGVPTIKPYHNFSLDPATCVLHYSFELFEGLKAYRDSNGKIRTFRPDKNMERMNRSAKRAALPTFDGEEFIKLVDQFLLIEERFVPTGYGYSLYLRPTLIGTSIGLGVSAPTKALLYLIASPVGPYFSGGFKPVSLEATDYAVRAWPKGVGSYKLGANYVSCIEPQMEAAKRGHSQNLWLFGEEGYITEVGAMNVFFAFKNADGTKELVTPPLDGMILPGVTRDSTLELAKSKLPSDWTVNERKLTIHEVKERAAKGELVEAFGTGTAAIVSPIDNIEFQGEQIKVPVSAGSSGEIALKINDWIKAIQYGDESFKNWSRVAQ

SEQ ID NO: 20 - DNA, 1224 bp, Kluyveromyces lactis
atgaactacattggactacggaattgtgcaagagctgtttccagcagagtttccattccatcaagaggtattaagagtcatattttaacaagttatagagccatgtccttagacgcatccaaggttaaaatcaccaaggtcgaaaccccatcgaagccacgtccaaacgatgagttggttttcggtcaaactttcactgaccatatgttaaccatcgaatggacagctgaaaacggttggggtgtcccagagattaaaccatacgggaacttgtcgttagatccatcctcgtgtgtgttccactatgctttcgaattgttcgaaggtttgaaggcgtacagaaccccagacaacaagatcagcatgttccgtgctgataagaatatggaacgtatgaacaagtcagcagccagaatctgtttgccatcttttaattcggatgagttgatcaagttgatcggtaagttgatcgaacaagacaagcatttggtgcctcaaggtcaaggttactccttgtacatcagacctacaatgattggtactactaacggattgggtgttggtactccagacagagctttgttgtatgtgatcacatctccagtgggaccatattacaagactgggttcaaagccgtgagattggaagctacggattatgctactagagcttggccaggtggtgttggtgacaagaagcttggtgccaactacgcaccatgtatcttgcctcaattgcaagctgctgaacgtggttaccaacaaaacttgtggttgttcggtccagaaaagaacatcactgaagtcggtactatgaacgtcttcttcgtgttcaaggactccaagaccggcaagaaggaattggttactgctccattggacggtaccattttggaaggtgtcactagagactctattctacaattggccagagaaaacttgaactctgacgagtggatcgtctctgaacgttactacactatcaccgaagtggaagaaagagctgccaagggcgaattggtcgaagcgttcggttccggtaccgctgctgtcgtgtctccaatcaaggaaatcggctggaacggtcacgatatccaagtgccattgttgcctggtgaacaatgtggtccattgaccaagcaagtggctgaatggattgccgatatccaatatggcagaaaagaacacaagggatggtcccgtatcgttgctgacttgaactaa

SEQ ID NO: 21 - protein, 407 aa, Kluyveromyces lactis
MNYIGLRNCARAVSSRVSIPSRGIKSHILTSYRAMSLDASKVKITKVETPSKPRPNDELVFGQTFTDHMLTIEWTAENGWGVPEIKPYGNLSLDPSSCVFHYAFELFEGLKAYRTPDNKISMFRADKNMERMNKSAARICLPSFNSDELIKLIGKLIEQDKHLVPQGQGYSLYIRPTMIGTTNGLGVGTPDRALLYVITSPVGPYYKTGFKAVRLEATDYATRAWPGGVGDKKLGANYAPCILPQLQAAERGYQQNLWLFGPEKNITEVGTMNVFFVFKDSKTGKKELVTAPLDGTILEGVTRDSILQLARENLNSDEWIVSERYYTITEVEERAAKGELVEAFGSGTAAVVSPIKEIGWNGHDIQVPLLPGEQCGPLTKQVAEWIADIQYGRKEHKGWSRIVADLN

SEQ ID NO: 22 - DNA, 1167 bp, Yarrowia lipolytica
atgcttcgaaacaacttgagatcgctttcgcgggccttcagcacctcctccatgcgtctgggcgccggaatggacgcctccaagctccagatcaccaagaccaagtcccccaaggaaaagcaggcccccaaggatctcattttcggccataccttcaccgaccacatgctgactgtcgagtggactgccaaggacggctgggctgctccccagatcaccccctacggtcctcttgagctggatccctccgccgtcgtcctgcactatgcctttgagtgtttcgagggcctcaaggcttacaaggacgagtctggaaacgtgcgtctgttccgagtcgacaagaacatgcaccgaatgaacacatcggccgagcgaatctgcctgcccgagtttgatggcgccgaggctgccaagctgattggccaattggccaagcttgattccgcttggatccccgagggacgaggctactccatgtacctccgaccttctctgattggaaccaccgccgctctcggcgtcggaacccccgataaggcgctcttttacgtcattgcatcccccgtcggcccctactaccctaccggattcaaggccgtcaagctggaggctactgactacgctgtccgagcctggcctggaggagtcggaaacaagaagctgggagccaactacgctccctgtatcaagcctcagcagcaggccgcttctcgaggctaccagcagaacctgtggctgtttggcgacgagggcaacatcaccgaggtcggtaccatgaacgccttctttgtgtttgagcgaaacggcaagaaggagcttgtcactgctcctttggacggtactattctcgagggtgtcactcgagactccattctggagctggctcgagaacgattgccttctgctgactggatcgtttccgagcgatactgcactattaaagaggtcgcggaggctgccgagaagggcgagcttgttgaggcctttggagctggtactgccgctgttgtctcgcctatcaaggagattggatggggagagaagactattaacattcctctccagcctggcaaggaggccggtaagctgactgagactgttaatgagtggattggagatatccagtacggtaaggatgaatacaagggatggtctaaggtggtctaa

SEQ ID NO: 23 - protein, 388 aa, Yarrowia lipolytica
MLRNNLRSLSRAFSTSSMRLGAGMDASKLQITKTKSPKEKQAPKDLIFGHTFTDHMLTVEWTAKDGWAAPQITPYGPLELDPSAVVLHYAFECFEGLKAYKDESGNVRLFRVDKNMHRMNTSAERICLPEFDGAEAAKLIGQLAKLDSAWIPEGRGYSMYLRPSLIGTTAALGVGTPDKALFYVIASPVGPYYPTGFKAVKLEATDYAVRAWPGGVGNKKLGANYAPCIKPQQQAASRGYQQNLWLFGDEGNITEVGTMNAFFVFERNGKKELVTAPLDGTILEGVTRDSILELARERLPSADWIVSERYCTIKEVAEAAEKGELVEAFGAGTAAVVSPIKEIGWGEKTINIPLQPGKEAGKLTETVNEWIGDIQYGKDEYKGWSKVV

SEQ ID NO: 24 - DNA, 1113 bp, Pichia stipitis
atgtctgctccattagatgcctccaagcttgtgatccacaagaccaccacccccaaggaaaagttgcccaacgataagttggtcttcggcaagaccttcaccgaccacatgttggaaatcgaatggactgctcaagccggctggggcactcctaccatttctccctaccacaagttgtctttggatccttctactgtcgtattgcactacgcttttgagttatttgaaggtatgaaagcttacagagacactgataacaacatcagaaccttcagaggtgacaagaacatggacagaatgaacaagtccgctgacagaatcgccttaccaacctttgatggtgaagagttgatgaagctcattgatcagttcttgctcgtagacgaaagctttgttccacaaggtgctggctactccctttatttaagaccaactatgatcggaaccaccgagtcattgggtgtaggtacgccagataaggcactcttgtatgttattgcatctcccgttggcccttactatggtactggcttcaagcctgtttccttagaagccactgactatgctgttagagcctggccaggtggtgtaggtaacagaaagttgggtgccaactatgctccttgtgtcagacctcagttagaggctgctaagagaggttaccaacaaaacttgtggttattcggagaggaaggctacattaccgaagtcggtaccatgaacgctttctttgtattcaagaacgctgacggcaccaaggagttggccactgctcctttggatggtaccatcttggaaggtgtcaccagagactcgatcttggaactcaccagagaaagattgccaaagaacgaatgggtagtgtccgaacgtaagttcaccattggtgaagttgaagaaagagctgccaagggtgagttgatcgaagcatttggtgctggtactgctgctgttgtttctcctatcaagtctattggctggaagggcaaggaaatcgaagttcctttggctgctggcgattccggcgaattgaccgctcaagttgctgagtggatcagaaagatccaatacggtgaagaacagtacaaaaactggtccagagttgctcaatag

SEQ ID NO: 25 - protein, 370 aa, Pichia stipitis
MSAPLDASKLVIHKTTTPKEKLPNDKLVFGKTFTDHMLEIEWTAQAGWGTPTISPYHKLSLDPSTVVLHYAFELFEGMKAYRDTDNNIRTFRGDKNMDRMNKSADRIALPTFDGEELMKLIDQFLLVDESFVPQGAGYSLYLRPTMIGTTESLGVGTPDKALLYVIASPVGPYYGTGFKPVSLEATDYAVRAWPGGVGNRKLGANYAPCVRPQLEAAKRGYQQNLWLFGEEGYITEVGTMNAFFVFKNADGTKELATAPLDGTILEGVTRDSILELTRERLPKNEWVVSERKFTIGEVEERAAKGELIEAFGAGTAAVVSPIKSIGWKGKEIEVPLAAGDSGELTAQVAEWIRKIQYGEEQYKNWSRVAQ

SEQ ID NO: 26 - DNA, 1860 bp, Saccharomyces cerevisiae
atggttaaagagagtattattgctcttgctgagcatgcggcctccagagcctcaagagttattcctccagtgaagctagcctataaaaatatgcttaaggacccttcctccaagtacaagccatttaacgctccaaagctatctaatagaaagtggccggataaccggatcacgagggctcctcgttggttatcaacagatttgagagatggtaaccaatctctgccggatcccatgtcagtggaacaaaagaaagaatactttcacaagctggtcaatattgggttcaaagaaatcgaggtttccttcccctctgcatctcaaacagatttcgacttcactagatatgctgtagaaaacgccccagacgatgttagtattcaatgtcttgtccaatctagagaacacttgattaagagaacggtggaagcattaacaggtgctaaaaaggctactatacatacttacttggcaacaagtgatatgttccgtgaaattgtttttaatatgtctagagaggaagctatttccaaggcagtagaggccaccaaactagttaggaaactaactaaggatgacccttcccaacaagccactcgttggtcctatgagttttcccccgaatgtttcagtgatactccaggtgaatttgctgtagaaatttgcgaagctgttaagaaggcttgggaacctaccgaggaaaatccaatcattttcaacttacctgctaccgtagaagttgcctctccaaatgtttatgctgatcagattgaatacttcgctacccatattactgagcgtgagaaggtttgcatctctacacattgtcacaatgaccgtggttgcggtgtcgccgccacagagttaggtatgcttgcaggtgccgaccgtgtagaaggatgtctctttggtaatggtgaacgtacaggtaatgtggacttggttactgttgctatgaatatgtatacccaaggtgtttctcctaatttggatttctctgacttgacctctgtcctagatgtggttgagcgttgtaataagatcccagtatcgcaaagagcaccatacggcggtgacttggtcgtttgtgccttttccggttctcaccaagacgccattaagaagggtttcaacttacaaaacaagaagcgtgctcaaggtgaaactcaatggagaatcccatacttgccattggatccaaaggacattggccgtgattacgaagctgtcatcagagtcaactctcagtctggtaaaggtggtgccgcttgggttattttgagatctttgggtttggatctaccaagaaacatgcaaatcgaattttctagcgccgttcaagaccatgctgactccttgggtagagaactaaaatcagatgagatttccaagttattcaaagaggcttacaactacaatgacgaacagtaccaagctattagtttagtcaattataatgttgaaaaattcggcactgaacgtagagtgttcactggtcaagtcaaagtaggcgaccagatcgtcgatattgaaggtacaggtaatggtccaatctcttctttggtcgacgccctatcaaacttgttgaacgtgagatttgccgtagcaaactacacagagcattctctaggttctggttcttctacgcaagctgcttcttacatccatctatcgtataggcgtaatgccgacaacgaaaaggcctacaaatggggtgtaggtgtctccgaagatgtcggtgattcttcagtgagagccatctttgccaccattaacaatattatccattctggtgatgtgtccattccatctttggccgaggtcgaaggtaagaatgctgcggcatctggctctgcataa

SEQ ID NO: 27 - protein, 619 aa, Saccharomyces cerevisiae
MVKESIIALAEHAASRASRVIPPVKLAYKNMLKDPSSKYKPFNAPKLSNRKWPDNRITRAPRWLSTDLRDGNQSLPDPMSVEQKKEYFHKLVNIGFKEIEVSFPSASQTDFDFTRYAVENAPDDVSIQCLVQSREHLIKRTVEALTGAKKATIHTYLATSDMFREIVFNMSREEAISKAVEATKLVRKLTKDDPSQQATRWSYEFSPECFSDTPGEFAVEICEAVKKAWEPTEENPIIFNLPATVEVASPNVYADQIEYFATHITEREKVCISTHCHNDRGCGVAATELGMLAGADRVEGCLFGNGERTGNVDLVTVAMNMYTQGVSPNLDFSDLTSVLDVVERCNKIPVSQRAPYGGDLVVCAFSGSHQDAIKKGFNLQNKKRAQGETQWRIPYLPLDPKDIGRDYEAVIRVNSQSGKGGAAWVILRSLGLDLPRNMQIEFSSAVQDHADSLGRELKSDEISKLFKEAYNYNDEQYQAISLVNYNVEKFGTERRVFTGQVKVGDQIVDIEGTGNGPISSLVDALSNLLNVRFAVANYTEHSLGSGSSTQAASYIHLSYRRNADNEKAYKWGVGVSEDVGDSSVRAIFATINNIIHSGDVSIPSLAEVEGKNAAASGSA

SEQ ID NO: 28 - DNA, 1755 bp, Schizosaccharomyces pombe
atgaaatctacttttgaggctgctggccgcgttgccaaagggatgctcaaggatccctccaaaaagtataagccatttaaaggaattcaactacccaaccgtcaatggccaaacaaggttttgacgaaagctccacgctggctttctacggacttgcgtgatggtaatcaggctttacccgatcctatgaatgggcaggagaaattgagatattttaaattgctttgcagtattggcttcaaagaaattgaggttggtttcccaagtgcttctcaaactgattttgcatttgttcgtcatctgattgaaacgccaggtttgattcctgacgatgttactatttctgcccttactccttctcgtgagcctttgatcctacgtacgattgaggctcttcgaggcgctaagaatgccactgttcacttgtataatgcctgttctcctcttttccgtgaagttgtcttccgcaacagtaagcaagaaacattggatttagccatcaaaggctcaaaaatcgtaacagctgctacgaaaaatgctcttgaatcgaaggaaaccaactggggatttgaatattctcctgaaactttttcagacaccgaaccagactttgctttggaagtttgtgaagctgtcaagggtatgtggaaaccttctgctgcccaacctattatcttcaatcttcctgccactgtcgaaatgtctacgcccaacacatatgctgacttaattgagtacttttccactaacattagtgaacgtgaaaaagtctgtgtttctctccatccccataacgaccgtggtactgctgtcgcagcagctgaacttggtcaacttgccggaggtgaccgtattgagggctgtttgtttggcaatggtgaacgtactggtaatgtagacttggttactttggctttcaacttgtatacccaaggtgtttctcctaacctcgatttctccaagttggatgaaatcattcgtattactgaagactgtaacaagataaacgttcatccccgtcatccttatgctggcaatcttgtctttaccgccttttctggttctcatcaagatgccatttctaagggtttgaaggcttacgatgagcgtaaagctgtcgatcctgtttggaaagtcccttacttgcctttggatccccatgatgtcaattccgagtatgctgctattatccgcgttaactctcaatctggcaagggtggtgtcgcatatctgttgaagaccaactgtggtctcgatttacctcgtgctttgcaagttgaatttggtagtattgttaaggattatagcgacacaaaaggaaaggagcttagcattggtgagatcagcgacctgttttataccacatattacctcgaatttcccggccgtttctctgtaaacgactacactctttctagcaacggacctcaaagcaaatgtattaaatgcgttgttgacatcaagggtgaaaagaaagatactccttcgcgggttgtgatcgagggtgttggaaatggacctttgtcggcattggttgatgctttacgccgtcagttcaatatttcatttgacattggtcaatactctgaacatgctattggttctggtaacggcgtcaaagctgcttcttatgttgagatcattttcaataacacttctttctggggtgttggtattgatgctgacgttacctctgccggattaaaggctgtcatgtcaggcgttagtcgtgcctcccgcgcatttgctaagtaa

SEQ ID NO: 29 - protein, 584 aa, Schizosaccharomyces pombe
MKSTFEAAGRVAKGMLKDPSKKYKPFKGIQLPNRQWPNKVLTKAPRWLSTDLRDGNQALPDPMNGQEKLRYFKLLCSIGFKEIEVGFPSASQTDFAFVRHLIETPGLIPDDVTISALTPSREPLILRTIEALRGAKNATVHLYNACSPLFREVVFRNSKQETLDLAIKGSKIVTAATKNALESKETNWGFEYSPETFSDTEPDFALEVCEAVKGMWKPSAAQPIIFNLPATVEMSTPNTYADLIEYFSTNISEREKVCVSLHPHNDRGTAVAAAELGQLAGGDRIEGCLFGNGERTGNVDLVTLAFNLYTQGVSPNLDFSKLDEIIRITEDCNKINVHPRHPYAGNLVFTAFSGSHQDAISKGLKAYDERKAVDPVWKVPYLPLDPHDVNSEYAAIIRVNSQSGKGGVAYLLKTNCGLDLPRALQVEFGSIVKDYSDTKGKELSIGEISDLFYTTYYLEFPGRFSVNDYTLSSNGPQSKCIKCVVDIKGEKKDTPSRVVIEGVGNGPLSALVDALRRQFNISFDIGQYSEHAIGSGNGVKAASYVEIIFNNTSFWGVGIDADVTSAGLKAVMSGVSRASRAFAK

SEQ ID NO: 30 - DNA, 1257 bp, Schizosaccharomyces pombe
atgtctgtgtccgaagctaatggtactgagaccatcaagcctcctatgaatggaaacccttatggtcccaacccatctgattttctttcacgtgtcaataacttttccattattgagtctactcttcgtgaaggtgagcaattcgcaaacgcttttttcgacaccgagaagaaaattcaaattgctaaggcattggacaactttggtgtcgattacattgaattgacttctcccgtggcttctgagcagtcccgccaagattgcgaagctatttgcaaattgggcttaaagtgtaaaattttaactcatattcgctgtcatatggatgacgctcgtgtcgctgttgagactggagttgatggtgttgatgttgttatcggaacttctcaatatcttcgcaaatattcccatggaaaggacatgacttacattattgacagcgctaccgaagttatcaactttgtcaagagcaagggtattgaagtccgcttttcatctgaggattctttccgttctgatcttgtcgatctcctttctctctacaaggctgtagacaagattggcgtcaaccgtgttggtattgctgacaccgttggttgcgctactcctcgccaagtctacgatcttattcgtaccttacgtggtgttgtctcttgtgatattgaatgtcattttcacaatgacactggtatggctattgctaatgcctattgcgcattggaagctggtgctacccatatcgatacttccattcttggtattggtgagcgtaatggtattactcctcttggtgccttgttggctcgtatgtatgtcaccgatagggaatacattacccacaaatacaagcttaaccagttacgtgagcttgaaaaccttgtcgctgatgccgttgaagttcaaattcctttcaacaattacattaccggaatgtgtgcttttacccataaggctggtatccatgctaaagctattctcgctaacccttctacatatgaaattcttaagcccgaggactttggcatgagtcgttatgttcatgttggctctcgtttgactggttggaatgccatcaaatctcgtgctgagcagcttaaccttcatcttactgatgcccaagccaaggaacttaccgttcgcatcaagaaattggctgatgtccgtactttagccatggatgatgttgatcgtgttctacgtgaataccatgctgacttgagtgatgctgatagaatcaccaaagaagcgtctgcttaa

SEQ ID NO: 31 - protein, 418 aa, Schizosaccharomyces pombe
MSVSEANGTETIKPPMNGNPYGPNPSDFLSRVNNFSIIESTLREGEQFANAFFDTEKKIQIAKALDNFGVDYIELTSPVASEQSRQDCEAICKLGLKCKILTHIRCHMDDARVAVETGVDGVDVVIGTSQYLRKYSHGKDMTYIIDSATEVINFVKSKGIEVRFSSEDSFRSDLVDLLSLYKAVDKIGVNRVGIADTVGCATPRQVYDLIRTLRGVVSCDIECHFHNDTGMAIANAYCALEAGATHIDTSILGIGERNGITPLGALLARMYVTDREYITHKYKLNQLRELENLVADAVEVQIPFNNYITGMCAFTHKAGIHAKAILANPSTYEILKPEDFGMSRYVHVGSRLTGWNAIKSRAEQLNLHLTDAQAKELTVRIKKLADVRTLAMDDVDRVLREYHADLSDADRITKEASA

SEQ ID NO: 32 - DNA, 1740 bp, Candida albicans
atgcaaaaggttttccaaagatgggtatctagaatacccccagttaagctccaatataagaatatgcttagagacccttccaaaaaatactctccaccaaaacagatcaacttgcccaatagaacttggcccaccaaagtaatcactaaagctccccgctggctttccactgatttaagagacggtaaccagtccttgccagatccaatgtcggttccagaaaaaaaagaatacttccataaattaattgatattgggtttaaagaaatcgaagtttcgttcccctctgcttcgcaaactgattttgatttcacccgatacgccgttgaaaatgcgccagatgatgtaactattcaagtcttgacccaatctcgtgaaccattgatcagaagaacagtggaatcggtaaaaggggccaagcgtgctaccattcatacatatttggcaacctctgatgtattccgtgaagttgttttcggtatgagcaaacaagacgctatagacaaggccattgaaactacaaaattagtgagatcattaactaaagatgaccctaacatgcaagacactgaatggaatttggagttttctccagagtgtttctcagatacgccagttgaatttgccgttgagatttgtgaagccgttaaaaaagcttgggaaccaacagtggaaaacccaatgatcttcaatttgcctgccacagttgaagttgctggtcctaatgtttatgctgatcagattgaatacttttgtcaaaacataactgaacgtgaaaagattattgtctccacccatactcataatgaccgtggctgtggtgtcgctgctaccgaattgggtatgttggctggtgccgatagagtggaaggttgtgtgtttggaaacggtgaaagaaccggtaatgttgacttggtcacggtggcattgaacttgtacacccaaggtattgcgccaaatttggacttttccgatatcgagagcattattgaggttagtgaacgttgtaataaaatcccggtgcccgcaagatcaccttacggtggctcacttgtggtgtgtgccttcagtggatctcatcaagacgccattaaaaagggttttgctaaacaaaagggagacaaatgggctatcccatacttgccattagatccaaaagatattggcagaacttacgaagccgtgattagagtcaactcccaatcaggtaaaggtggtgctgcctgggtcatccttagatctttgggattggacttgccaagacacttacaagttgccttttcaggattggtgcaaaacactgctgacctgttgggtagagaattgaaggttgatgaaattgtcaacttgttcaacgaacaatacttggtgagtgcccctttaagcattcaggattttgaaatcaccaagaataaaaacgatgaaagagaaattgttgctcaattaaatgatggcatcaccattaaaggtcaaggtaatggtcctatctctgcttttattgatgcaatttctaacaagttcggtgttttgtttgaagttgtaaactatcaagaacattctttgggaggtggttctagtagtaaggcagcaacttatatcgaattatcatatgttaatgccaatggtgaaaaagttactagatggggttgtggtatcaatcacgatgtgtcacaagcctcaatcgaagccattcttagtgttgtaaactctttgattaaaaagaatgaattaactgtatag

SEQ ID NO: 33 - protein, 579 aa, Candida albicans
MQKVFQRWVSRIPPVKLQYKNMLRDPSKKYSPPKQINLPNRTWPTKVITKAPRWLSTDLRDGNQSLPDPMSVPEKKEYFHKLIDIGFKEIEVSFPSASQTDFDFTRYAVENAPDDVTIQVLTQSREPLIRRTVESVKGAKRATIHTYLATSDVFREVVFGMSKQDAIDKAIETTKLVRSLTKDDPNMQDTEWNLEFSPECFSDTPVEFAVEICEAVKKAWEPTVENPMIFNLPATVEVAGPNVYADQIEYFCQNITEREKIIVSTHTHNDRGCGVAATELGMLAGADRVEGCVFGNGERTGNVDLVTVALNLYTQGIAPNLDFSDIESIIEVSERCNKIPVPARSPYGGSLVVCAFSGSHQDAIKKGFAKQKGDKWAIPYLPLDPKDIGRTYEAVIRVNSQSGKGGAAWVILRSLGLDLPRHLQVAFSGLVQNTADSLGRELKVDEIVNLFNEQYLVSAPLSIQDFEITKNKNDEREIVAQLNDGITIKGQGNGPISAFIDAISNKFGVLFEVVNYQEHSLGGGSSSKAATYIELSYVNANGEKVTRWGCGINHDVSQASIEAILSVVNSLIKKNELTV

SEQ ID NO: 34 - DNA, 1722 bp, Candida albicans
atgcctatgttaaaagatccctcagtgaaatataagaagtttccaaatgtcaatttgccaaaccgtcaatggccatcaagaagcttggataaaccaccaagatggttatctactgatttgagagatggtaaccaatcattacctgatccaatgtcgatctctgaaaagaaagaatatttcaagaaattggttgatataggattcaaagaaatcgaagttgccttcccctcagcctctcaaattgatttcgatttcactagatttgccgttgaaactgcccctgaagatgtttcgattcaagttctttctccatgtcgtcccgaattgattggtagaactgttgaatctttgaaaggtgctaaaagagcaactgtccacatatatcttgccacttctgattgttttagaaatgttgtgtttggactttccaaagaagaatcaaaggccttagctgtgaaatgtaccaaattggtgagacaattaactaaagatgatccttcaactgccggtacagattgggattttgaattttctccagaaactttttctgacacagatttggattatgctgttgaagtatgtgaagcagtcaaagaagcctgggggccaacagaagataaaccaattatatttaatttgccagcaactgttgaaatggccactcctaacatatatgctgatcaaattgaatattttgccactcatattactgaccgtgaaacagtttgtatttcattgcatcctcacaatgatagagggtgtagtgttgctgctgccgaattaggtcaattagctggtgctgacagagttgaaggttgtcttttcggtaatggtgaaagaaccggtaatgttgatttagtcactttagcattgaacttgtatacccagggggtatcaccaaaattggacttttctgatttgaattcggtcattgatatagttgaaaaatgcaacaaaattcctgttcatgctagagctccatacggagggtctcttgttgtttgtgcctttagtggatctcatcaagatgccatcaaaaaggggttcctggctcacgaaaagaaaaaagaaaaagcgggaggcaaagaagttcattggcaattaccttatttaccattggatccagaagatattggaagaacatacgaggctattattagagtgaattctcaatctggtaaaggtggttctgcttgggtgatcttgagaaatttggaattagatttacctcgtggtttacaaattgccttctctaaagtggttcaagcacgtgctgaagttaaaggtcaagaattaactaacgaagaattatgtgagttattcaagcaagaatatttcattgattatgatgatgaagccccagaacaatactttaaattagtagattactcgatatcgacaccaagcaaaggaatcaaggaaatccaagctgatattgaagtcgatggtaaagtcatttctatcaaaggtgaaggtaatggtcaattatctgcctttaataatgccattgctaaatatttgaatattgatattgacgtgaaacattatcacgaacattcccttggtgaagattcaaaagcccgtgccgccacttatattgaagtcttggtcgataaaaaagttgcaagatggggtgtgggtattcatactgatgtttctcaagcttcattcttatctttgatatctattttgaatggtttgcataaaaataaaaacatttaa

SEQ ID NO: 35 - protein, 573 aa, Candida albicans
MPMLKDPSVKYKKFPNVNLPNRQWPSRSLDKPPRWLSTDLRDGNQSLPDPMSISEKKEYFKKLVDIGFKEIEVAFPSASQIDFDFTRFAVETAPEDVSIQVLSPCRPELIGRTVESLKGAKRATVHIYLATSDCFRNVVFGLSKEESKALAVKCTKLVRQLTKDDPSTAGTDWDFEFSPETFSDTDLDYAVEVCEAVKEAWGPTEDKPIIFNLPATVEMATPNIYADQIEYFATHITDRETVCISLHPHNDRGCSVAAAELGQLAGADRVEGCLFGNGERTGNVDLVTLALNLYTQGVSPKLDFSDLNSVIDIVEKCNKIPVHARAPYGGSLVVCAFSGSHQDAIKKGFSAHEKKKEKAGGKEVHWQLPYLPLDPEDIGRTYEAIIRVNSQSGKGGSAWVILRNLELDLPRGLQIAFSKVVQARAEVKGQELTNEELCELFKQEYFIDYDDEAPEQYFKLVDYSISTPSKGIKEIQADIEVDGKVISIKGEGNGQLSAFNNAIAKYLNIDIDVKHYHEHSLGEDSKARAATYIEVLVDKKVARWGVGIHTDVSQASFLSLISILNGLHKNKNI

SEQ ID NO: 36 - DNA, 1254 bp, Candida albicans
atgtctgttgcttctaatccatatggtccaaatccatctgatttcttatctaatgtgaataaatttgaagtcattgaatcaactttaagagaaggtgaacaatttgccaatgcctttttcaccactgaaaaaaaaattgaaattgctaaagctttagatgattttggggttgattatattgaattgacttcaccagtggcatctgaacaatcaagaagagattgtgaagccatttgtaaattgggtttaaaagccaaaatattgacacatattagatgtcatatggatgatgcccgtgttgccgttgaaactggggttgatggggttgatgtggttattggaacttcacaatttttaagacaatattctcatggtaaagatatgaattatattgctcaaagtgctattgaagtcattgaatttgttaaatctaaaggtattgaaattcgttttagttctgaagattcttttagatcagatattgttgatttattaaacatttatcgtactgttgataaaatcggagtgaatagagttggtattgccgatactgttggttgtgctaacccaagacaagtttatgaattggttaaaactttgaaatcggtggtttcttgtgatattgaatgtcatttccataacgatactggttgtgccattgctaatgcttatactgccttggaagccggtgctaaattgattgatgtttctgtgttgggtattggtgaaaggaatggtattactccattgggggcattaatggcaagaatgattactgctgatcgtgattatgtgttatctaaatataaattacacaaattgagagatttagaaaatttggttgctgatgccgtacaaattaatattccattcaataatccaattactggattctgtgcttttactcataaagctggtattcatgctaaagccatcttggccaatccatcaacatatgaaatcttgaatccaaatgatttcggtttaaccagatatattcactttgctaatagattgactggttggaatgccattaaatcaagagttgatcaattgaatttacatttgactgatgatcaagttaaagaagttacaaataaaattaaaaaattgggtgatgttagacaattgaacattgatgatgtcgattcaattattaaagatttccatgctgaacaaagcactaccaatactcctcttttaaaaccagtagaggatgatgaaggtccagaaattaaaaaacaaaaagtatag

SEQ ID NO: 37 - protein, 417 aa, Candida albicans
MSVASNPYGPNPSDFLSNVNKFEVIESTLREGEQFANAFFTTEKKIEIAKALDDFGVDYIELTSPVASEQSRRDCEAICKLGLKAKILTHIRCHMDDARVAVETGVDGVDVVIGTSQFLRQYSHGKDMNYIAQSAIEVIEFVKSKGIEIRFSSEDSFRSDIVDLLNIYRTVDKIGVNRVGIADTVGCANPRQVYELVKTLKSVVSCDIECHFHNDTGCAIANAYTALEAGAKLIDVSVLGIGERNGITPLGALMARMITADRDYVLSKYKLHKLRDLENLVADAVQINIPFNNPITGFCAFTHKAGIHAKAILANPSTYEILNPNDFGLTRYIHFANRLTGWNAIKSRVDQLNLHLTDDQVKEVTNKIKKLGDVRQLNIDDVDSIIKDFHAEQSTTNTPLLKPVEDDEGPEIKKQKV

SEQ ID NO: 38 - DNA, 1287 bp, Candida albicans
atggttgacggatataaagaagtatcagaatcatttgatcgttccaaaatccaacataacccttatggtcctaatccaggtgattttctttcgaatgttggcaattttcaattgattgaatcaactttgagagaaggtgaacagtttgccaatgcatttttcagcaccgaaaccaaaattgaaattgctaaagccttagatgattttggggttgattatattgaattgacttcaccagtggcatctgaacaatcaagaaaagattgtgaagccatttgtaaattaggtttaaaagccaaaatattgactcacattagatgtcatatggatgatgccagagttgctgttgaaactggggtcgatggagttgatgtggttattggaacttcccaatttttaagacaatactctcatggtaaggatatgaattatattgcacaaagtgctattgaagtcattgaatttgtcaaatctaaaggtattgaaatccgtttcagttctgaagattcttttagatcagatttggttgatttattaaacatttaccgtactgttgataaaattggggttaacagagttggtattgctgatactgttggttgtgctaatccaagacaagtttatgaattggtgagaacattgaaatcagtagtcaagtgtgacattgaatgtcatttccataatgatactggctgtgccattgccaatgcatacacagctttggaaggtggggccagattgattgatgtttccgtattgggtattggtgaaagaaatggtattactccattgggtgggttaatggcgagaatgattgctgctgatcgtgaatatgttttgtcaaaatataaagttcataaattgagagatattgaaaatttggttgctgaggcggttcaagttaacattccattcaataatccgatcactgggttctgtgctttcactcataaagctggtatccatgctaaagctatcttggccaatccatctacttatgaaattttgagtccaagtgatttcggtttaaccagatatattcactttgctaatagattgactggttggaatgccatcaaatcaagagttgatcagttgaacttgcatttaactgatgaacagtgtaaagaagtcactaacaagattaagaaattgggtgatgtcagacaattgaatatcgatgatgtggattcaatcatcaaagatttccatgctgatatgtcaacaccacttttgaaatcaaatggagcggaagaagaaccagatgtaaaaaaacaaaaagtttaa

SEQ ID NO: 39 - protein, 428 aa, Candida albicans
MVDGYKEVSESFDRSKIQHNPYGPNPGDFLSNVGNFQLIESTLREGEQFANAFFSTETKIEIAKALDDFGVDYIELTSPVASEQSRKDCEAICKLGLKAKILTHIRCHMDDARVAVETGVDGVDVVIGTSQFLRQYSHGKDMNYIAQSAIEVIEFVKSKGIEIRFSSEDSFRSDLVDLLNIYRTVDKIGVNRVGIADTVGCANPRQVYELVRTLKSVVKCDIECHFHNDTGCAIANAYTALEGGARLIDVSVLGIGERNGITPLGGLMARMIAADREYVLSKYKVHKLRDIENLVAEAVQVNIPFNNPITGFCAFTHKAGIHAKAILANPSTYEILSPSDFGLTRYIHFANRLTGWNAIKSRVDQLNLHLTDEQCKEVTNKIKKLGDVRQLNIDDVDSIIKDFHADMSTPLLKSNGAEEEPDVKKQKV

SEQ ID NO: 40 - DNA, 1827 bp, Candida glabrata
atgagagctaccgttatcagactctcgagggctgcgaagtcaattccgcccgtgaaattggcgtataagaacatgttgaaagacccttccatcaaatacaaaccattctccattgctccaaagcttactgacaggaaatggccagacaataccattaccaaggcaccaaggtggttgtctacagacttgagagacggtaaccagtctctcccggacccgatgtccattgagcagaagaaagagtacttccacaagctggtggagattggcttcaaagagatagaagtcagttttccatctgcctcgcagaccgacttcgatttcacaaggtacgctgtggagaatgctccagatgatgttaccatacagtgtcttgtgcaatccagagaacacttgatcagaagaactgtggagtcgttgactggtgccaagcgtgccactatacatacttacttggccaccagcgacatgttcagagagatagtcttcaacatgtctaaggaagacgctatcgccaaagccgtcgaagccactaaactggtcagaagcttgaccaaggacgacccttctcagcaggctacccgttggtcctatgagttctctccagaatgtttcagtgataccccagtcgaatttgccgttgaaatctgtgaagcagtaaaagctgcctgggaaccaaccgaggacaaccctatcatatttaacctacctgccacagtcgaggtcgcctctccaaacatctacgctgaccaaatcgaatatttctgcacacacatcaccgaaagagagaaggtgtgtgtctctacgcatacccacaacgaccgtggctgcggtgttgccgctaccgaacttggtataatggcaggcgctgatcgtgttgaaggttgtgtcttcggaaatggtgaacgtactggtaacgttgacttggtaaccgtggcattgaacatgtacacgcaaggtgtctctcctaacttggacttctccgacataaggtctgtaatcgaggttgttgaacgttgtaacaaattgcctgtcccagccagagcaccatacggtggtgacttggtcgtatgtgcattctctggttctcaccaggacgccatcaagaagggtttctcggttcaacaaaagaagcgtgaccaaggcgacattcaatggagaatcccatatttgccattggatccaaaggatatcggccgtgactacgaagctgtcatcagagtcaactctcaatctggtaagggtggtgctgcttgggttgtcctaagagccttgggcctagacatgccaagaaccatgcaaattgagttctccaccagtgtacaagaacacgctgactctctaggtagagaactaaaggccgaagagattgtcaacttgtttaaggaatcttacaactacaacaacgaaatcttccaacatatctctttggttgattacaacgttgagaaattcggtgctgagcgcagaattctaaatggtcaagttgaaatcaatggtgaagttgtcgacatcaagggtaccggtaacggtccaatctcttctttggtcgatgctttgtccaacttattgaacatcaaacttggtgtcagcaactatagtgaacactctttgggttcaggttcatccactcaagccgcttctttcatcaacttaacttacagacgtgatgaagataatgaaaaggcttaccaatggggtgtaggtgtgtctgaggatgttggtgatgcttctgtcaaggcaatctttgccactttgaattctgtaattcaaaaaggtgacattagtatcccaaagtctaagaaggctgcctctggttctgcttaa

SEQ ID NO: 41 - protein, 608 aa, Candida glabrata
MRATVIRLSRAAKSIPPVKLAYKNMLKDPSIKYKPFSIAPKLTDRKWPDNTITKAPRWLSTDLRDGNQSLPDPMSIEQKKEYFHKLVEIGFKEIEVSFPSASQTDFDFTRYAVENAPDDVTIQCLVQSREHLIRRTVESLTGAKRATIHTYLATSDMFREIVFNMSKEDAIAKAVEATKLVRSLTKDDPSQQATRWSYEFSPECFSDTPVEFAVEICEAVKAAWEPTEDNPIIFNLPATVEVASPNIYADQIEYFCTHITEREKVCVSTHTHNDRGCGVAATELGIMAGADRVEGCVFGNGERTGNVDLVTVALNMYTQGVSPNLDFSDIRSVIEVVERCNKLPVPARAPYGGDLVVCAFSGSHQDAIKKGFSVQQKKRDQGDIQWRIPYLPLDPKDIGRDYEAVIRVNSQSGKGGAAWVVLRALGLDMPRTMQIEFSTSVQEHADSLGRELKAEEIVNLFKESYNYNNEIFQHISLVDYNVEKFGAERRILNGQVEINGEVVDIKGTGNGPISSLVDALSNLLNIKLGVSNYSEHSLGSGSSTQAASFINLTYRRDEDNEKAYQWGVGVSEDVGDASVKAIFATLNSVIQKGDISIPKSKKAASGSA

SEQ ID NO: 42 - DNA, 1818 bp, Candida glabrata
atgagacaaacaattccaaattttgcagagcatgtctctcgtgcagccaagacaattgctccagtcaaattgggtttcaagaatatgcttgctaatccaagtgtcaaatatagaccatttcaaggcccaaaattgacaaatagacaatggcctaacaagacaattaagagagctccaagatggctttctaccgatttgagagatggtaaccaatctctcccggaccctatgtcagtagagcaaaagaaagaatactttcacaaacttgttgaaatcgggtttaaagagatagaagtcagttttccgtcagcatcgcaaaccgatttcgatttcacaagatacgctgtagaaaacgcaccagacgatgtttctatccagtgtcttgtccaatctagggagcatctgatcaagaggacagttgaagcattgaccggtgctaagcgtgctaccatacatacatacttggccacaagtgatatgttccgtgagattgttttcaatatgtctcaagaagaagccattgccaaagctgtagaagcaaccaagctagtacggaaattgaccaaggatgatccatctcaaaaagcaactaggtggtcttacgaattttctccagaatgttttagtgatacaccagtagaatttgccgttgaaatctgtgaggctgtgaaagctgcatgggaaccaacggttgataatcctattatctttaacttacctgcaaccgttgaagtagcaactccaaatgtatacgctgatcagatcgaatacttctctactcatattagcgaacgtgaaaaggtttgtatctccacccatgctcacaatgaccgtggctgtggcgttgctgctacagagttgggtatcttggctggtgctgatcgagttgaaggctgtatattcgggaatggtgaacgtacaggtaatgtcgacctggtaaccgtcgccttaaacatgtatacccagggtgtttctcccggtcttgacttttcagacatgagaagtgttatcgagatcgttgaacgttgtaacaagattccagtaccagctagagctccatatggtggtgaccttgttgtttgcgccttttcaggctctcaccaagatgctattaaaaaaggatttgctttacaacaaaagaagcgtgctcaaggtgaaactttatggaggattccatatttgccattagatccaaaggacatcggccgtgactatgaagcggttatcagggtcaactcacaatctggtaagggtggtgctgcttgggttattttaaggtctttgggtctagacaccccaagaaacatgcaaatgcaattctctaccattgtgcaaaatgaagctgacacaagaggcaaggaattatctgcagaggagattactgcattattcaagtctacctataattacaacaacgaaacccatcaatacgtatctttgctcgactatgatgtgaagaagattgacaacgaccgtagaatcctaacagggcaagttgaaattaacgacaagatcattccaattaagggtattggtaacggtcctatttcttctttagtagatgccctatcaaacttattcaacgtcaaatttggtgttgaaaactatacagaacatgctttaggttccggttccaaaacccaagccgcctctttcattcacatctcttacagagatgctgctaccaatgaaaaggagtacagttggggtgtcggtgtctctgaagatgttggtgaagcatctgttagggccattttctcaaccattaacagcattatccattcaggtgaagtcactcttcctactgaaaacaattag

SEQ ID NO: 43 - protein, 605 aa, Candida glabrata
MRQTIPNFAEHVSRAAKTIAPVKLGFKNMLANPSVKYRPFQGPKLTNRQWPNKTIKRAPRWLSTDLRDGNQSLPDPMSVEQKKEYFHKLVEIGFKEIEVSFPSASQTDFDFTRYAVENAPDDVSIQCLVQSREHLIKRTVEALTGAKRATIHTYLATSDMFREIVFNMSQEEAIAKAVEATKLVRKLTKDDPSQKATRWSYEFSPECFSDTPVEFAVEICEAVKAAWEPTVDNPIIFNLPATVEVATPNVYADQIEYFSTHISEREKVCISTHAHNDRGCGVAATELGILAGADRVEGCIFGNGERTGNVDLVTVALNMYTQGVSPGLDFSDMRSVIEIVERCNKIPVPARAPYGGDLVVCAFSGSHQDAIKKGFALQQKKRAQGETLWRIPYLPLDPKDIGRDYEAVIRVNSQSGKGGAAWVILRSLGLDTPRNMQMQFSTIVQNEADTRGKELSAEEITALFKSTYNYNNETHQYVSLLDYDVKKIDNDRRILTGQVEINDKIIPIKGIGNGPISSLVDALSNLFNVKFGVENYTEHALGSGSKTQAASFIHISYRDAATNEKEYSWGVGVSEDVGEASVRAIFSTINSIIHSGEVTLPTENN

SEQ ID NO: 44 - DNA, 1752 bp, Kluyveromyces lactis
atgccattctacaaagatccttcagtgaagtataaaccattcgttagcaacgtcaaattacaggacaggaaatggcctagtaaaacccttaataaggctccaagatggttagctaccgatttaagagatgggaatcagtctttacctgacccgatgaatttggaagagaagaaactgatgctcgataagttatgcgaattgggtttcaaagagattgaagttgctttccctagtgcttctaatatcgatttccaattcactcaatatgcagtgaaaaacgtaccagaagacgtttccattcaagttctttctccatgtcgtgaacccttgatcgaacgtaccgttgaatctttggtcggtgccaagagagccattgtacatatctatctcgcgacatcaccatgtttcagagaaatcgttttcaacaatatgtctcatgaagaaagtattgaaaaggctgtgaaatgtgccaaacttgttaggtccttgacaaaagaccatccggatagacaagatacccattggtcatttgagttttctccagaaacgttcagcgatagtgaaccggatttcgttctagagatttgtgaagctgttaaggctgcttggggacccactgaagataatccaatcattttcaatttgccagctaccgtcgagatggctacaccaaacgtgtacgctgaccaaatcgaatatttcgctcaaagtatctccgaacgtgagaaagtatgtatctctctccatccacataacgatcgtgggtgtgctgtggcagctgcagaattagctcaaatggctggtgcagatcgtgtcgagggatgtctcttcggtaacggtgaacgtaccggtaacgttgatttggttaccttggcattaaacctctacacacagggtgtatctccaaacctcgatttctccgatatggcttctattattgaagtcgttgagaaatgtaataagattcccgtgcatgctagagcaccctacggaggacaacttgtcgtttgtgcattcagtggttctcatcaagatgccatcaaaaagggtttcgaaaaatacgacaacaaggttaaggctttacaagaaaaagagggtccagatgcagtggtaccttggaaaatgccatatctccccttggatcctcaggatattggaagaacgtatgaggctatcatcagagtcaactcgcaatcaggtaaaggtggttcttcttgggttatcctaaagaacttggagctagatttaccaagagatctacaaattgcatactctaagatcgttcaaaatgaaactgagatagtcggtagagagttgaagagcgatgaactaatctctttattcgagaaatcgtatttcgttggatctcattcaactactggtaaattcaagtttatcgactataaatatgacaaatctccggagaatttcactctttcggtgcagctatcagatggaactactcaatgggatttggaaggtactggtaacggtccaatctcttctttcatcgatgctgtgaataaaaacttcaaaactaatcttgatgtgaaaaactatcatgagcattccttgggtaagagttccgattcgagagctgctacttatatctctgtctctcatgaaggatttgttcaatggggtgttggtattcatgaggatactactctggcttcattcttggcgttgttatcttgtataaacggtcttgatagggcaaagaacttcactgtcaattcagctgccaattga

SEQ ID NO: 45 - protein, 583 aa, Kluyveromyces lactis
MPFYKDPSVKYKPFVSNVKLQDRKWPSKTLNKAPRWLATDLRDGNQSLPDPMNLEEKKLMLDKLCELGFKEIEVAFPSASNIDFQFTQYAVKNVPEDVSIQVLSPCREPLIERTVESLVGAKRAIVHIYLATSPCFREIVFNNMSHEESIEKAVKCAKLVRSLTKDHPDRQDTHWSFEFSPETFSDSEPDFVLEICEAVKAAWGPTEDNPIIFNLPATVEMATPNVYADQIEYFAQSISEREKVCISLHPHNDRGCAVAAAELAQMAGADRVEGCLFGNGERTGNVDLVTLALNLYTQGVSPNLDFSDMASIIEVVEKCNKIPVHARAPYGGQLVVCAFSGSHQDAIKKGFEKYDNKVKALQEKEGPDAVVPWKMPYLPLDPQDIGRTYEAIIRVNSQSGKGGSSWVILKNLELDLPRDLQIAYSKIVQNETEIVGRELKSDELISLFEKSYFVGSHSTTGKFKFIDYKYDKSPENFTLSVQLSDGTTQWDLEGTGNGPISSFIDAVNKNFKTNLDVKNYHEHSLGKSSDSRAATYISVSHEGFVQWGVGIHEDTTLASFLALLSCINGLDRAKNFTVNSAAN

SEQ ID NO: 46 - DNA, 1830 bp, Kluyveromyces lactis
atgatattcaggaacaccgttgtgcgtttagcacaggctgggaaaaaagctattcctccagtgaaactagcgtacaagaatatgctaaaagatccatcgacgaaatatagaccatacccacagatcaacttggaaaatagacaatggccttcgaagaccatcaccaaggctcctaggtggctttctaccgatctaagagacgggaatcaatctttaccagatcctatgtctgtcgagcagaagaaggaatatttccataagttgattgagattggtttcaaagaaattgaggtctcattcccatctgcgtcgcaaacagatttcgacttcacaagatacgctgttgaaaacgccccagaagatgtttccattcaatgtcttgttcaatcgagagaacatttgattagaagaacagttgaagctttgcatggtgctaagaaagccaccatccatacgtatttggccacctccgacatgttccgtgacattgtgttcaacatgtcccaagaagaagctattgctaaagctgtggaagccaccaagttagttaggaaattgaccaaggatgatccttcgcaaagtgctacacaatggacttaccagttctctccagaatgtttcagtgatacacctgtagaatttgctgttgagatctgtgaagccgtaaaggctgcttgggaaccaactgaggaaaacccaatcattttcaacctacctgctaccgtcgaagtcgctactccaaacatttacgctgatcaaattgaatacttttcaactcacatatctgaacgtgaaaaggtctgtatctccacacatgcgcacaacgaccgtggctgtggtgttgctgcttctgaactaggtattttggctggtgctgaccgtgtcgaaggttgtttattcggtaatggtgaacgtactggtaacgttgacttggttactgtcgcattgaacatgtacactcaaggtgtttctccagaattagacttatctgatattaactcagtcattgaagtagtggaaagatgtaacaagattgcagtttcaccaagagccccatatggtggtgacttggtcgtttgtgctttcagtggttctcatcaagatgctatcaaaaagggtttcaatcttcaagaaaagagacgtagtcaaggtgatactctatggaaaattccatacttgccattggatccaaaggatatcggtagagactacgaagctgtcatccgtgtcaactctcaatctggtaaggggggtgccgcttgggttgtcttgagatctttgggcctagatttgccaagaaacttgcaaattgaattttccactcaagtgcaagaaaaggctgatgctctaggtaaggaactaaaggcaaacgaaattgtcagcaccttcaagtcgttatacaacctcgatggaagcgcctccaacatttctttgttagaatacaatgtttctaaagtacagggtgatcagaagagttttgttggtcaagtccagatcgacaacgaagtcgtcggcattgaaggtctcggaaacggtccaatttcctctctaatcgatgcgttgtcaaatttgctcggtgttaaacttggtgttgccaactacaccgaacattccttaggatctggttcttcaacaaaggctgcttcttacgtgcatattgcttacagaagagaaattgacaacgaaaaggcctaccaatggggtattggtatgtctgaagatgttggagaggcttctgccaaagccatcctttctgctgttaataacttgatcaaaaagggcgaactaacaataccagctcatcgtgactcagcctcagcatctgcatag

SEQ ID NO: 47 - protein, 609 aa, Kluyveromyces lactis
MIFRNTVVRLAQAGKKAIPPVKLAYKNMLKDPSTKYRPYPQINLENRQWPSKTITKAPRWLSTDLRDGNQSLPDPMSVEQKKEYFHKLIEIGFKEIEVSFPSASQTDFDFTRYAVENAPEDVSIQCLVQSREHLIRRTVEALHGAKKATIHTYLATSDMFRDIVFNMSQEEAIAKAVEATKLVRKLTKDDPSQSATQWTYQFSPECFSDTPVEFAVEICEAVKAAWEPTEENPIIFNLPATVEVATPNIYADQIEYFSTHISEREKVCISTHAHNDRGCGVAASELGILAGADRVEGCLFGNGERTGNVDLVTVALNMYTQGVSPELDLSDINSVIEVVERCNKIAVSPRAPYGGDLVVCAFSGSHQDAIKKGFNLQEKRRSQGDTLWKIPYLPLDPKDIGRDYEAVIRVNSQSGKGGAAWVVLRSLGLDLPRNLQIEFSTQVQEKADALGKELKANEIVSTFKSLYNLDGSASNISLLEYNVSKVQGDQKSFVGQVQIDNEVVGIEGLGNGPISSLIDALSNLLGVKLGVANYTEHSLGSGSSTKAASYVHIAYRREIDNEKAYQWGIGMSEDVGEASAKAILSAVNNLIKKGELTIPAHRDSASASA

SEQ ID NO: 48 - DNA, 1341 bp, Yarrowia lipolytica
atgtgcgcaacagataacgcccccgccgctaacgctgctcctgagaagccctccaacgttggagtcgaggtcggtcacaccggcgagcagactaatccttacggagccaaccccgccgatttcctttctaacgtgtccaagttccagctcatcgagtccactctgcgagagggagagcagtttgcctctgccttctttgacaccgagaccaagatcgagattgccaaggctctggacgactttggtgtcgactacatcgagctgacctcccccgcagcatcggagcagtcgcggtccgattgcgaggccatctgcaagctcggtcttaaggccaagattctcactcacatccgatgccacatggacgacgcaagactcgctgtctccaccggtgtcgatggtgtcgatgtcgtcattggtacctcccagttcctgcgacagtactcccacggcaaggacatgaactacattgcacagtccgctgtcgaggtcattgagtttgtcaagagccacggcattgagatccgattctcctccgaggattctttccgatccgacctggtcgatctcctcaacatctaccgaactgtcgacaagattggtgtcaaccgagtcggtattgctgacactgttggatgcgccaacccccgacaggtctacgagcttgtccgaaccctcaagtccgttgtctcgtgcgacattgagtgccatttccacaacgacaccggctgtgccattgccaacgcctacaccgccctcgaggctggtgccaacctcatcgatgtctccgttctcggtatcggtgagcgaaacggtatcacctctctcggtggtctgatggctcgaatgattgctgctgaccgagactacgttctctccaagtacaagctgcacaagctgcgagacctcgagaacctcgtcgccgacgccgtccaggtcaacatccccttcaacaaccccatcaccggtttctgcgccttcacccacaaggccggtatccacgccaaggccattctcgccaacccctccacttacgagattctcaaccccgccgatttcggtctgacccgatacatccactttgccaaccgtcttaccggctggaacgccatcaagtcgcgagttgaccagctcaacctgcacctgaccgacgcccagtgcaaggatgtcactgccaagatcaagaagcttggtgacgttcgatctctcaacattgacgatgttgactccatcatccgagagttccacgccgatgtcaccagcactcccaccgttgctgccaccgagggacctgccgttgaggacgagcccgccgccaagaaggccaagactgaagagtaa

SEQ ID NO: 49 - protein, 446 aa, Yarrowia lipolytica
MCATDNAPAANAAPEKPSNVGVEVGHTGEQTNPYGANPADFLSNVSKFQLIESTLREGEQFASAFFDTETKIEIAKALDDFGVDYIELTSPAASEQSRSDCEAICKLGLKAKILTHIRCHMDDARLAVSTGVDGVDVVIGTSQFLRQYSHGKDMNYIAQSAVEVIEFVKSHGIEIRFSSEDSFRSDLVDLLNIYRTVDKIGVNRVGIADTVGCANPRQVYELVRTLKSVVSCDIECHFHNDTGCAIANAYTALEAGANLIDVSVLGIGERNGITSLGGLMARMIAADRDYVLSKYKLHKLRDLENLVADAVQVNIPFNNPITGFCAFTHKAGIHAKAILANPSTYEILNPADFGLTRYIHFANRLTGWNAIKSRVDQLNLHLTDAQCKDVTAKIKKLGDVRSLNIDDVDSIIREFHADVTSTPTVAATEGPAVEDEPAAKKAKTEE

SEQ ID NO: 50 - DNA, 1728 bp, Yarrowia lipolytica
atgccctacctggccgatccctccaccaaatacaagccgttccccccgatcaatctgcccaaccggcagtggccgtcgaaaacgctgcagaagcccccgcggtggctgtcgacggacctgcgggacggcaaccagtcgctgccggatcccatgaccatggcggagaagaaggagtacttccagaagattgtcgacattggctacaaggagatcgaggtggcgttcccgtccgcctcgcaggtggactttgacttcacccgctttgcctgcgacaccgcccccgaagacgtgtggatccaggtgctggctccgtgccgagaggatctcatcacccgaaccgtcgagtccgtcaagggcgccaacaaggccatcatccacatctacctcgccacctccaagtgcttccgggacattgtcttcaaccattcgcgagaagaggccctggccaaggccgtggcatgcgccaagcacgtgcgagccctgaccaaggactcggacgaccccgagtgcaaaaagaccacctggggttttgagttctcccccgagaccttctccgacaccgacgtggactacgccattgaggtctgtgaggccgtgaaggccgcctggggcccctccgaggagaaccccatcattttcaacctccccgccaccgtcgaaatggccacccccaacatctacgccgaccagattgagtactttgccaccaacatttccgagcgggagaagatttgcatttctctgcacccccacaacgaccgaggttgtgccgtggctgctgccgagctgggccagatggccggagccgaccgagtcgagggctgtctgtttggcaacggcgagcgaaccggaaacgtcgacctcgtcactctgggtctgaatttgtacacccagggcgtgcatcccaagattgacttctccgacatcacctcgatcatcgacattgtggagcgatgcaacaagatccccgtgcacccccgagctccctacggcggccagctggtggtgtgtgccttctccggctctcaccaggacgccatcaagaagggctttgctcgaatcgaagacgtcaaggatgaggtggccgagggcaagcgacagtggcagatcccctacctgcctcttgaccccaaggacattggccgaacctacgaggcagtcattcgagtcaattcgcagtccggcaagggaggagccgcctggatcattctgcgatctctggagctcgatctgccccgaggcctgcaggttgccttctccaaggtggtccagaaggaggccgaggtggttggacaggagctgtctgcccagcagttggtggatctctttgagcgagagtacggcgtgtttgaggagcagcagggcaagtaccagctggacgactttgaggtgaccaacaagtccaaggaggagcgagagctgaccggagctctgaccgtcgagggcaagcgagtcgagctcaagggtaccggtaacggtcccatttcgtccttcctggatgccatcaagaacgcctttggctacaacctcgaggttctcaactaccacgagcactccattggtaagggttccaagaccaaggctgctacttacattgagctggcctatgaggaggacggcaagacttccaagcgatggggtgttggtattgacgaggatgtttcccaggcttctattcatgctattctgtctgccatgaacgccattagcgagtcctacaagaaataa

SEQ ID NO: 51 - protein, 575 aa, Yarrowia lipolytica
MPYLADPSTKYKPFPPINLPNRQWPSKTLQKPPRWLSTDLRDGNQSLPDPMTMAEKKEYFQKIVDIGYKEIEVAFPSASQVDFDFTRFACDTAPEDVWIQVLAPCREDLITRTVESVKGANKAIIHIYLATSKCFRDIVFNHSREEALAKAVACAKHVRALTKDSDDPECKKTTWGFEFSPETFSDTDVDYAIEVCEAVKAAWGPSEENPIIFNLPATVEMATPNIYADQIEYFATNISEREKICISLHPHNDRGCAVAAAELGQMAGADRVEGCLFGNGERTGNVDLVTLGLNLYTQGVHPKIDFSDITSIIDIVERCNKIPVHPRAPYGGQLVVCAFSGSHQDAIKKGFARIEDVKDEVAEGKRQWQIPYLPLDPKDIGRTYEAVIRVNSQSGKGGAAWIILRSLELDLPRGLQVAFSKVVQKEAEVVGQELSAQQLVDLFEREYGVFEEQQGKYQLDDFEVTNKSKEERELTGALTVEGKRVELKGTGNGPISSFLDAIKNAFGYNLEVLNYHEHSIGKGSKTKAATYIELAYEEDGKTSKRWGVGIDEDVSQASIHAILSAMNAISESYKK

SEQ ID NO: 52 - DNA, 1716 bp, Pichia stipitis
atgttaaaggatccttccaccaaatatgctgcctttaaaggagtcaagttggacaagagaacctggccctcaaagtctatcaccaaggctcctaggtggttatctactgatttaagagatggtaaccaagcgttgcctgatcccatgtctgtcgaagagaagaaggagtattttcacaagctcttggagatcggattcaaagaaatcgaggtatctttcccttctgcatctcaaacagattttgacttcaccagatatgctgtggagaacgcaccagatgatgtttcgatccaagttttgactcagtctagagaacctttgatcagaagaactgttgaatccgtaaagggtgctaagaaggctaccatacatacatacttggctacttctgacgttttccgtgatgttgttttcaacatgtcacaagaagatgcaattgccaaagccattgaaactaccaagttggtcaagtctttgacaaaggacgatccagaaatgcaggaaaccgagtggaccttggaattctctcctgaatgcttctcagatactcctaccgaatttgctgtgcaaatttgtgaagcagtcaagaacgtctgggagccaactgtagagaatcctatcattttcaacttgccagctaccgttgaagttgcttctccaaacgtctacgctgaccagatcgaatactttgctacccacatttccgaacgtgaaaaggtgtgtatttctcttcatgctcacaatgaccgtggctgcggtgttgctgcctcggaattaggtttattggctggcggagacagagtcgaaggttgtttgtttggaaacggtgaaagaaccggtaacgtagacttgatcactgttgctctcaacatgtacaccaatggagttgcaccggagttggacttttcagaaatcgaaaagctcatcgaggtcagtgaaagatgtaacaaaatcccagttcacccaagagctccatactctggatccttggtcgtttgtgccttctctggttctcaccaagatgctatcaagaagggattctccaaggctgaagccagagctgctaggggtgacaccaaatgggccattccatacttgccattagaccctaaggatatcggtagaaactacgaggccgttatcagagtcaactctcaatctggtaagggaggtgctgcctgggtcatcttgagatctctcggcttggacttgccaagacacttgcaagttgtcttttctggtattgttcaggaaagagctgactctttgggtagagaattgaagtctgaagagattgccgctttgttcaacgagcagtactgctctacttccaacttgtctgtcaaggacttcgagataactaagagaaagaatgctccagagaacaaggaccgtgagatctttgctgtcttgcaggctggatccaagaccgttgacgtcagtggacaaggtaacggacctatttcggcctttgtggatgccatatccaagaaatacggtgtttcctttgaagtcgtcaactacagtgaacacagtttaggcagtggtacccagagtaaggctgctacttacattgagttagcctacaacaactctaacaacgagcatgttacaaagtggggatgcggcattaacacagatgtgtcgcaggcttcgatggaggccattctttctgttgtgaactcattgattgatagcaaggaaattaatttgtag

SEQ ID NO: 53 - protein, 571 aa, Pichia stipitis
MLKDPSTKYAAFKGVKLDKRTWPSKSITKAPRWLSTDLRDGNQALPDPMSVEEKKEYFHKLLEIGFKEIEVSFPSASQTDFDFTRYAVENAPDDVSIQVLTQSREPLIRRTVESVKGAKKATIHTYLATSDVFRDVVFNMSQEDAIAKAIETTKLVKSLTKDDPEMQETEWTLEFSPECFSDTPTEFAVQICEAVKNVWEPTVENPIIFNLPATVEVASPNVYADQIEYFATHISEREKVCISLHAHNDRGCGVAASELGLLAGGDRVEGCLFGNGERTGNVDLITVALNMYTNGVAPELDFSEIEKLIEVSERCNKIPVHPRAPYSGSLVVCAFSGSHQDAIKKGFSKAEARAARGDTKWAIPYLPLDPKDIGRNYEAVIRVNSQSGKGGAAWVILRSLGLDLPRHLQVVFSGIVQERADSLGRELKSEEIAALFNEQYCSTSNLSVKDFEITKRKNAPENKDREIFAVLQAGSKTVDVSGQGNGPISAFVDAISKKYGVSFEVVNYSEHSLGSGTQSKAATYIELAYNNSNNEHVTKWGCGINTDVSQASMEAILSVVNSLIDSKEINL

SEQ ID NO: 54 - DNA, 1728 bp, Pichia stipitis
atgcctatgttagctgatccatcccaaaagtacaagcctttccctcctgtacatttacccaatcgtcaatggccatctcgtacgcttgaaaaaccacctagatggctttccaccgacttgagagatggaaaccagtccttaccagatcccatgtcaattgctgaaaagaaggagtacttcaagaagttggtagatattggtttcaaggaaatcgaagtggcctttccttcggcatcgcagatcgactttgacttcaccagattcgctgtggaaacagctccagcagacgttgctgtccaggtcttgtctccctgtagagaggacttgatcaagcgtactgtagagtcgttgaccggagccaaaaaggctattgtgcacatatacttggctacgtcggactgcttccgtaacgtagtctttggattaaccaaggaagagtcgaaggctcttgccgtaaaatgcgccaagttggtcagatctttgactaaagatgaccccaagcaacaagcaactgagtgggactttgagttctcgccagaaaccttttcagacaccgatatggactacgctgtagaggtctgcgaagccgtcaaggaggcctggggccctactgaagacagacctatcatcttcaacttgccagctaccgtggaaatggctactccaaacatatatgccgaccagatcgagtactttgctactcacatctcggaaagagaaaagatcgcaatttcgttacatccccacaacgacagaggatgttctgttgctgccgctgagctcggccagttagctggtgctgacagagttgagggatgcttatttggaaatggagaaagaacaggtaacgttgacttggtcaccttggctctcaacttgtatactcagggtgtttcacctaagcttgacttctccgatatcaactctgttatcgacgtagtagaaaagtgtaacaagattcctgttcatgcaagagctccttatggaggtgcccttgtcgtttgtgccttcagtggatcgcaccaagacgccatcaagaaaggtttcaatgtgcacgagaagaaggtcgaagctgctgcaggaaaacatgtccactggcagttaccctacttgccattggaccctcaggatattggcagaacttacgaggccatcatcagagtcaactcgcagtctggtaagggtggttccgcttgggtcatcttgagaaacttggagctcgacttgcccagaggattgcaagtggctttctccaaggtggttcaacagcgtgctgaagtcaagggtcaggagttgaccaacgaagaattgtgtgacttgttcaagcaagaatactacattgactacgagggtgacaacttcaacgaccagacctacaagttgatcgactactccatcctgactcctgccaagggccagaaggaaattgaagccgaaatccagatcgatgacaagatcgtcaagatcaagggccagggtaacggtcagctttcggctttcaatgctgccctctccaaacacctcaacatcgacttaaacgtcaagcactaccacgaacactcattgggtgtagactcgaattctcgtgcagccacctacatcgaagtctcactcaaaaacgacaacgtcaccagatggggtgtgggtatccatgaagatgtctcgcaagcttctttcttatctctcatctccatcttgaacggcttgcacagaaacaaggatatttag

SEQ ID NO: 55 - protein, 575 aa, Pichia stipitis
MPMLADPSQKYKPFPPVHLPNRQWPSRTLEKPPRWLSTDLRDGNQSLPDPMSIAEKKEYFKKLVDIGFKEIEVAFPSASQIDFDFTRFAVETAPADVAVQVLSPCREDLIKRTVESLTGAKKAIVHIYLATSDCFRNVVFGLTKEESKALAVKCAKLVRSLTKDDPKQQATEWDFEFSPETFSDTDMDYAVEVCEAVKEAWGPTEDRPIIFNLPATVEMATPNIYADQIEYFATHISEREKIAISLHPHNDRGCSVAAAELGQLAGADRVEGCLFGNGERTGNVDLVTLALNLYTQGVSPKLDFSDINSVIDVVEKCNKIPVHARAPYGGALVVCAFSGSHQDAIKKGFNVHEKKVEAAAGKHVHWQLPYLPLDPQDIGRTYEAIIRVNSQSGKGGSAWVILRNLELDLPRGLQVAFSKVVQQRAEVKGQELTNEELCDLFKQEYYIDYEGDNFNDQTYKLIDYSISTPAKGQKEIEAEIQIDDKIVKIKGQGNGQLSAFNAALSKHLNIDLNVKHYHEHSLGVDSNSRAATYIEVSLKNDNVTRWGVGIHEDVSQASFLSLISILNGLHRNKDI

SEQ ID NO: 56 - DNA, 1101 bp, Saccharomyces cerevisiae
atgttttccagactgccaacatcattggccagaaatgttgcacgtcgtgccccaacttcttttgtaagaccctctgcagcagcagcagcattgagattctcatcaacaaagacgatgaccgtcagagaggccttgaatagtgccatggcggaagaattggaccgtgatgatgatgtcttccttattggtgaagaagttgcacaatataacggggcttataaggtgtcaaagggtttattggacaggttcggtgaacgtcgtgtggttgacacacctattaccgaatacgggttcacaggtttggccgttggtgccgctttgaagggtttgaagccaattgtagagtttatgtcgttcaatttctctatgcaagctatcgatcatgttgtcaattccgctgcaaagactcactacatgtctggtggtactcaaaaatgtcaaatggtcttcagaggtcctaatggtgctgcagtgggtgttggtgctcaacattcacaggacttttctccttggtacggttccattccagggttaaaggtccttgtcccttattctgctgaagatgctaggggtttgttaaaggccgccatcagagatccaaaccctgttgtatttttagagaacgaattgttgtacggtgaatcttttgaaatctcagaagaagctttatcccctgagttcaccttgccatacaaggctaagatcgaaagagaaggtaccgatatttccattgttacgtacacaagaaacgttcagttttctttggaagccgctgaaattctacaaaagaaatatggtgtctctgcagaagttatcaacttgcgttctattagacctttagatactgaagctatcatcaaaactgtcaagaagacaaaccacttgattactgttgaatccactttcccatcatttggtgttggtgctgaaattgtcgcccaagttatggagtctgaagcctttgattacttggatgctccaatccaaagagttactggtgccgatgttccaacaccttacgctaaagaattagaagatttcgctttccctgatactccaaccatcgttaaagctgtcaaagaagtcttgtcaattgaataa

SEQ ID NO: 57 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 58 - DNA, 1101 bp, Schizosaccharomyces pombe
atgattcgtcttcaaaagtttggtgaaattgttgggaccagtcgttcttggaaacttcttagttcaaccatcgcaaagcgctattcttcttcttccaatggagtgaaggaaatgaccgttcgtgatgctttgaacagtgcaatggaagaagaaatgaaacgtgacgatcgtgtcttcttgattggcgaagaggttgcgcaatacaatggtgcttataagatatctagaggtttattagacaagtttggtcctaaacgtgttatcgacactcccattactgaaatgggttttactggtttggcaacaggtgctgcttttgctggtttacgtcctatttgtgagtttatgactttcaatttttccatgcaggctatcgatcatatcgttaactcggccgccagaaccctgtacatgtctggtggtattcaggcttgtcctattgtcttccgtggacctaatgggcctgccgctgcagttgctgctcagcattctcaacactttgctccatggtatggtagtatccctggtcttaaagtagtttctccttactcagcagaagatgctcgtggtttgttgaaggctgctattcgtgatcctaatcccgttgttgtacttgaaaacgaaattctttatggtaaaacctttccaatttcgaaagaagcgttgagcgaggactttgtgcttccctttggccttgctaaggtggagcgccccggtaaagatatcaccatcgttggtgagtctatttctgttgttactgctttagaagcagctgacaagctcaaggctgactatggtgttgaagctgaagttataaacttgcgtagtattcgtcctttagacatcaatactatcgcggccagtgttaagaagacaaatcgtattgtgactgttgaccaggcatatagtcaacatggtattggtagtgaaattgctgctcaaattatggagtctgacgcatttgattatcttgatgctcctgttgaacgtgtaagtatggcagatgttcccatgccttatagtcatcctgttgaggctgcttctgtcccaaatgccgatgttgttgttgctgctgctaaaaaatgcttgtatattaaataa

SEQ ID NO: 59 - protein, 366 aa, Schizosaccharomyces pombe
MIRLQKFGEIVGTSRSWKLLSSTIAKRYSSSSNGVKEMTVRDALNSAMEEEMKRDDRVFLIGEEVAQYNGAYKISRGLLDKFGPKRVIDTPITEMGFTGLATGAAFAGLRPICEFMTFNFSMQAIDHIVNSAARTLYMSGGIQACPIVFRGPNGPAAAVAAQHSQHFAPWYGSIPGLKVVSPYSAEDARGLLKAAIRDPNPVVVLENEILYGKTFPISKEALSEDFVLPFGLAKVERPGKDITIVGESISVVTALEAADKLKADYGVEAEVINLRSIRPLDINTIAASVKKTNRIVTVDQAYSQHGIGSEIAAQIMESDAFDYLDAPVERVSMADVPMPYSHPVEAASVPNADVVVAAAKKCLYIK

SEQ ID NO: 60 - DNA, 1140 bp, Candida albicans
atgtcatcattatcatcagtcaccaggagtgctaaattagccactcaatctttgaaatacaacactagaccatcattatctaaaattggtcaatttcaaacatcaaaaatcacttatcgtgccaattccacacaatcaactcctgtcaaagaaattactgtcagagatgctcttaaccaagctttatctgaagaattagacagagatgaagatgttttccttatgggtgaagaagttgcccaatacaatggtgcctataaagtcagtagaggattattggacaaatttggtgaaaagagagttattgacactccaattactgaaatggggttcactggattagctgttggtgctgctttacatggtcttaaaccagttttggaatttatgacttggaattttgctatgcaaggtattgatcatattttaaattctgctgctaaaactctttatatgtctggtggtaaacaaccatgtaatataactttccgtggtcctaatggtgctgctgctggtgttgctgctcaacattctcagtgttatgctgcttggtatggttcaattcctggtttaaaagttttatctccttattctgctgaagattataagggtttacttaaagctgccattagagatcctaacccagttgttttcttggaaaatgaaattgcttatggtgaaacttttaaagtttctgaagaattttcatctccagatttcattttaccaattggtaaagccaaaattgaaaaagaaggtactgatttaaccattgttggtcatagtcgtgcccttaaatttgccgttgaagccgctgaaattttggaaaaagatttcggaattaaagctgaagtgctcaatttaagatcaattaaaccattggatgttccagctattgttgattcagttaaaaagactaatcatttggttactgttgaaaatggattcccaggttttggtgttggttcagaaatttgtgctcaaattatggaaagtgaagcctttgattatttggatgctccagttgaaagagttactggttgtgaagttccaactccatatgctaaagaattggaagattttgctttcccagacactgaagttatcttgagagcttgtaaaaaagtattaagtttgtaa

SEQ ID NO: 61 - protein, 379 aa, Candida albicans
MSSLSSVTRSAKLATQSLKYNTRPSLSKIGQFQTSKITYRANSTQSTPVKEITVRDALNQALSEELDRDEDVFLMGEEVAQYNGAYKVSRGLLDKFGEKRVIDTPITEMGFTGLAVGAALHGLKPVLEFMTWNFAMQGIDHILNSAAKTLYMSGGKQPCNITFRGPNGAAAGVAAQHSQCYAAWYGSIPGLKVLSPYSAEDYKGLLKAAIRDPNPVVFLENEIAYGETFKVSEEFSSPDFILPIGKAKIEKEGTDLTIVGHSRALKFAVEAAEILEKDFGIKAEVLNLRSIKPLDVPAIVDSVKKTNHLVTVENGFPGFGVGSEICAQIMESEAFDYLDAPVERVTGCEVPTPYAKELEDFAFPDTEVILRACKKVLSL

SEQ ID NO: 62 - DNA, 1065 bp, Kluyveromyces lactis
atgatgatgctttctaacacttttaagagggctgttccttctgtggttcaatccatgagatttgcttctaccaagaccatgaccgtcagagaagctttgaattctgccatggccgaagaaatggaccgtgatgatgatgttttcatcattggtgaagaagttgctcaatataatggtgcttacaaggttaccaagggtttattggaccgtttcggtgaaagaagagttgttgacactccaattaccgaaatgggtttcactggtttggctgttggtgccgctttgaagggtttaaagccaattgttgaattcatgtctttcaacttctccatgcaagctatggatcaagtcattaactccgctgctaagacttactatatgtccggtggtactcagaaatgtcaaatcgttttcagaggtccaaacggttctgctgtcggtgttgctgctcaacattcccaagattattctgcttggtacggttctgttccaggtatgaaggttttggttccatactctgctgaagatgctagaggtttgttgaaggctgccattcgtgatccaaacccagttgttttcttggaaaacgaattgttatacggtcaatctttcgaagtctctgaagaatctctgtctactgatttcactttgccatacaaagcaaaggttgaaagagaaggttctgatatctctatcatcagttacaccagaaatgttcaattctctttggaagctgctgaaattttgtctaagcaatacggtgtttctgctgaagttatcaatttgagagccattagacctttggatgttgaagctatcatcaacactgtcaagaagaccaaccacttgattactgttgaatctactttcccagctttcggtgttggtgctgaaattatcgctcaaattatggaatctgaagccttcgattatttggatgctccaattcaaagagttactggtgctgaagtcccaactccttatgctaaggaattagaagattttgctttcccagaccctgacaccattgtcagagctgctaaaagtgttttgtctattgaatga

SEQ ID NO: 63 - protein, 354 aa, Kluyveromyces lactis
MMMLSNTFKRAVPSVVQSMRFASTKTMTVREALNSAMAEEMDRDDDVFIIGEEVAQYNGAYKVTKGLLDRFGERRVVDTPITEMGFTGLAVGAALKGLKPIVEFMSFNFSMQAMDQVINSAAKTYYMSGGTQKCQIVFRGPNGSAVGVAAQHSQDYSAWYGSVPGMKVLVPYSAEDARGLLKAAIRDPNPVVFLENELLYGQSFEVSEESLSTDFTLPYKAKVEREGSDISIISYTRNVQFSLEAAEILSKQYGVSAEVINLRAIRPLDVEAIINTVKKTNHLITVESTFPAFGVGAEIIAQIMESEAFDYLDAPIQRVTGAEVPTPYAKELEDFAFPDPDTIVRAAKSVLSIE

SEQ ID NO: 64 - DNA, 993 bp, Yarrowia lipolytica
atgactgtcagagacgccctcaacaccgcactgcgagaggagatggaccgaaacgataatgttttcatcatgggtgaggaggtcggccagtacaacggtgcctacaaggtcaccaagggccttctcgacaagttcggcgagaagcgagtggttgacacccctatcaccgagatgggtttcgccggtgtttgtgtcggtgccgccctggccggtctcacccccgtctgcgagttcatgacctggaacttcgccatgcaggccattgatcagatcatcaattccggtgccaagacctactacatgtccggaggtacccagcagtgcaatgtcaccttccgaggtcctaacggtgccgccgctggtgttgctgcccaacactctcaggatttcaccgggtggtacggccagattcccggtctcaaggtcgtctctccctacagctctgaggatgccaagggtctgctcaaggccgccatccgagaccccaacgtgactgttttcctcgagaacgagatcatgtacggagagtctttccccatgtctgaggaggccatgtcccccgacttcgttctgccccttggaaaggccaagattgagcgagagggtaaggatatcactcttgtcggtcactcccgaaacgtcgagaccgccctcaaggccgccgacctcctcaagaagcaccacaacgtcgatgccgaggtcattaacctgcgaactgtcaagcctctcgacactgagaccattttcaactccatcaagaagactaaccgacttgtctctgtcgaggctggcttccccgcctttggcatgggctccgagctctgtggtgtcgtcaacgactcctgggcctgggattaccttgatgcccccatccagcgagttaccggagctgaggttcccactccttacgccattgagcttgagaacttcgccttccccacacccgagattgttgtcaaggctgccaaggacgccctctacattgaggagtag

SEQ ID NO: 65 - protein, 330 aa, Yarrowia lipolytica
MTVRDALNTALREEMDRNDNVFIMGEEVGQYNGAYKVTKGLLDKFGEKRVVDTPITEMGFAGVCVGAALAGLTPVCEFMTWNFAMQAIDQIINSGAKTYYMSGGTQQCNVTFRGPNGAAAGVAAQHSQDFTGWYGQIPGLKVVSPYSSEDAKGLLKAAIRDPNVTVFLENEIMYGESFPMSEEAMSPDFVLPLGKAKIEREGKDITLVGHSRNVETALKAADLLKKHHNVDAEVINLRTVKPLDTETIFNSIKKTNRLVSVEAGFPAFGMGSELCGVVNDSWAWDYLDAPIQRVTGAEVPTPYAIELENFAFPTPEIVVKAAKDALYIEE

SEQ ID NO: 66 - DNA, 1170 bp, Pichia stipitis
atggctcccaagttatcccagatcgcccagacggcccgcttggccgcttcggccactagagcccacaacatcgccaatgtgactggaaacactaccagatccgtagcccaagctggccagtaccaggcattgagaatgatggattcgcgtgccgcttcgtcgtcggctgtaggctcaaagaccatcaccgtcagagacgcccttaatgccgggcttgccgaggagttggacaaggacgacgatgtcttcctcatgggtgaagaagtggcccaatacaacggtgcctacaaggtgtcacgtggtttgttggatcgttttggtgaaagacgtgtgattgatacccctatcactgaaatgggtttcactggtttggctgttggagctgcccttcatggtttgaagcctgtgttggagttcatgaccttcaacttcgctatgcaagctatcgatcaaatcgttaactctgccgctaagacctattacatgtccggaggtaaacaaccgtgtaacatcaccttccgtggtcccaatggtgctgctgccggtgtcggtgctcaacattcgcaatgttacgctgcatggtatggatctattcctggtttgaaggttgtttcgccctactctgccgaggactacaagggtttgatcaaggctgccatcagagaccctaacccagttgtgtttttggaaaacgaaatcgcctacggtgaaaccttcgatatctccgaggaagctctctccacagactttgttttgcctatcggcaaggccaatgtcgaaagagaaggaactgacttgacatttgtatcgcattccagatctgtcaagttctgtatggaagccgctgaaaccttggagaaggaatacggcgtcaaggccgaagtcatcaacttgagatccatcaagcctttggatgttcctaccattgttgagtcagtcaagaagactaaccacttggtcactgttgaagccggattcccagcctttggtgttggttctgaaatctgtgcccagatcatggaatccgaggcttttgattacttggatgctccagtcgaaagagtcactggttgcgaagttccaactccatatgctaaggaattggaagactttgctttcccagacgaacctaccgtaatcagagccgccaaaaaggtgttatctttgtaa

SEQ ID NO: 67 - protein, 389 aa, Pichia stipitis
MAPKLSQIAQTARLAASATRAHNIANVTGNTTRSVAQAGQYQALRMMDSRAASSSAVGSKTITVRDALNAGLAEELDKDDDVFLMGEEVAQYNGAYKVSRGLLDRFGERRVIDTPITEMGFTGLAVGAALHGLKPVLEFMTFNFAMQAIDQIVNSAAKTYYMSGGKQPCNITFRGPNGAAAGVGAQHSQCYAAWYGSIPGLKVVSPYSAEDYKGLIKAAIRDPNPVVFLENEIAYGETFDISEEALSTDFVLPIGKANVEREGTDLTFVSHSRSVKFCMEAAETLEKEYGVKAEVINLRSIKPLDVPTIVESVKKTNHLVTVEAGFPAFGVGSEICAQIMESEAFDYLDAPVERVTGCEVPTPYAKELEDFAFPDEPTVIRAAKKVLSL

SEQ ID NO: 68 - DNA, 1263 bp, Saccharomyces cerevisiae
atgcttgctgcttcattcaaacgccaaccatcacaattggtccgcgggttaggagctgttcttcgcactcccaccaggataggtcatgttcgtaccatggcaactttaaaaacaactgataagaaggcccctgaggacatcgagggctcggacacagtgcaaattgagttgcctgaatcttccttcgagtcgtatatgctagagcctccagacttgtcttatgagacttcgaaagccaccttgttacagatgtataaagatatggtcatcatcagaagaatggagatggcttgtgacgccttgtacaaggccaagaaaatcagaggtttttgccatctatctgttggtcaggaggccattgctgtcggtatcgagaatgccatcacaaaattggattccatcatcacatcttacagatgtcacggtttcacttttatgagaggtgcctcagtgaaagccgttctggctgaattgatgggtagaagagccggtgtctcttatggtaagggtggttccatgcacctttacgctccaggcttctatggtggtaatggtatcgtgggtgcccaggttcctttaggtgcaggtttagcttttgctcaccaatacaagaacgaggacgcctgctctttcactttgtatggtgatggtgcctctaatcaaggtcaagtttttgaatctttcaacatggccaaattatggaatttgcccgtcgtgttttgctgtgagaacaacaagtacggtatgggtaccgccgcttcaagatcctccgcgatgactgaatatttcaagcgtggtcaatatattccaggtttaaaagttaacggtatggatattctagctgtctaccaagcatccaagtttgctaaggactggtgtctatccggcaaaggtcctctcgttctagaatatgaaacctataggtacggtggccattctatgtctgatcccggtactacctacagaactagagacgagattcagcatatgagatccaagaacgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaa

SEQ ID NO: 69 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 70 - DNA, 1230 bp, Schizosaccharomyces pombe
atgtttcgaacttgtacgaagattggaacagttcccaaggttcttgtgaaccaaaagggcttgatcgatggccttcgtcgggtcaccacagacgcaaccacttctcgtgccaatccggctcatgtgcctgaggaacatgacaagccatttcctgttaaattagatgatagtgtattcgaaggatacaagatcgatgtcccttctactgaaatcgaagttacaaagggagagttattgggtttgtacgagaagatggtgactattcgtcgtctagaacttgcatgcgatgccttgtataaggctaagaagattcgtggattctgtcatcttagcattggccaagaagctgtagctgcaggaattgaaggtgctattacacttgacgacagtattatcacatcttatagatgccacggttttgcttatacccgtggtttgtcaattcgaagcattattggtgagctcatgggacgtcaatgtggtgcttccaagggcaagggtggttctatgcacattttcgccaaaaacttctatggtggtaatggtattgttggtgctcaaattcctttgggtgctggtattggtttcgcacagaagtatcttgaaaaacccactactacttttgctctatatggtgatggtgcatctaaccaaggtcaagctttcgaggccttcaacatggccaaattatggggtcttcccgttatttttgcttgtgaaaacaacaaatacggtatgggtactagtgctgaacgctcttctgccatgactgagttctacaaacgtggacagtacattcccggtcttttggttaacggtatggatgttttggctgttttgcaggcttcaaagtttgctaagaagtacactgttgaaaactctcaacctctgcttatggaatttgtgacttatcgttatggtggtcactccatgtccgatcccggtactacttatcgtagccgtgaagaagtgcaaaaagtacgtgctgctagagatcctattgagggtttgaagaagcacatcatggagtggggcgtcgctaatgccaatgagcttaaaaacattgagaagagaatccgtggtatggttgatgaggaggttcgtatcgctgaagaaagccctttccccgatcctattgaggagagtttgttttcagatgtttacgttgcaggaactgaacccgcttacgcccgtggtagaaattccctggaatatcatcaatataagtaa

SEQ ID NO: 71 - protein, 409 aa, Schizosaccharomyces pombe
MFRTCTKIGTVPKVLVNQKGLIDGLRRVTTDATTSRANPAHVPEEHDKPFPVKLDDSVFEGYKIDVPSTEIEVTKGELLGLYEKMVTIRRLELACDALYKAKKIRGFCHLSIGQEAVAAGIEGAITLDDSIITSYRCHGFAYTRGLSIRSIIGELMGRQCGASKGKGGSMHIFAKNFYGGNGIVGAQIPLGAGIGFAQKYLEKPTTTFALYGDGASNQGQAFEAFNMAKLWGLPVIFACENNKYGMGTSAERSSAMTEFYKRGQYIPGLLVNGMDVLAVLQASKFAKKYTVENSQPLLMEFVTYRYGGHSMSDPGTTYRSREEVQKVRAARDPIEGLKKHIMEWGVANANELKNIEKRIRGMVDEEVRIAEESPFPDPIEESLFSDVYVAGTEPAYARGRNSLEYHQYK

SEQ ID NO: 72 - DNA, 1206 bp, Candida albicans
atgtaccgtgcaacagctactagtcgccaattggtcggtactaccgccaatatacttgtcgccaaaagatcaatggccaaagccgcctcagatttggtcactatcgaattaccagccagctcctacgaaggatacaatttggaagttccagctttgagttttgaaaccgaaaaagaaaccttattgaaaatgtacaaagatatgattatcatcagaagaatggaaatggcagccgatgctttatacaagagtaaaaaaattagaggtttctgtcacttgtctgtcggtcaagaagccattgctgttggtattgaaaatgccattacaccaactgacactgtcattacctcttatagatgtcacggttttgcattcatgagaggtgcttctgtcaaatctgttttggccgagttaatgggtagaagatctggtattgccaacggtaagggtggatcaatgcatatgttcactaacggattctacggtggtaacggtattgttggtgcccaagttccattgggtgctggattggctttctcccacaagtacaagaacgacaaagctgtcacttttgatttgtatggtgatggtgcgtctaaccaaggacaagttttcgaagcttacaacatggccaaattgtggaacttaccagttattttcgcctgtgaaaacaacaagtatggtatgggtacctctgctgccagatcatcagctatgaccgaatactacaagagaggtcaatatatcccaggtttgaaaatcaacggtatggatgtgttggccacctaccaagcctccaaattcgccaaagactgggcttctcaaggcaatggacctcttgttttagaatacgaaacttacagatatggtggtcactccatgtctgatccaggtaccacttacagaaccagagaagaagtccaacatatgagatctagaaacgatccaattgctggattgaaagctgttttgttagaaaaagagattgcttctgaagacgaaatcaaatcttacgacaaagccgctagaaaatacgttgatgaacaagttgctgctgctgaagctgatgctccaccagaagctaaaatggatattttattcgaagacgtttatgttccaggtagtgagattcctgttttgagaggtagaatctccgacgatagttgggatttcaaaaacaagacttttttgaacaaggtctattaa

SEQ ID NO: 73 - protein, 401 aa, Candida albicans
MYRATATSRQLVGTTANILVAKRSMAKAASDLVTIELPASSYEGYNLEVPALSFETEKETLLKMYKDMIIIRRMEMAADALYKSKKIRGFCHLSVGQEAIAVGIENAITPTDTVITSYRCHGFAFMRGASVKSVLAELMGRRSGIANGKGGSMHMFTNGFYGGNGIVGAQVPLGAGLAFSHKYKNDKAVTFDLYGDGASNQGQVFEAYNMAKLWNLPVIFACENNKYGMGTSAARSSAMTEYYKRGQYIPGLKINGMDVLATYQASKFAKDWASQGNGPLVLEYETYRYGGHSMSDPGTTYRTREEVQHMRSRNDPIAGLKAVLLEKEIASEDEIKSYDKAARKYVDEQVAAAEADAPPEAKMDILFEDVYVPGSEIPVLRGRISDDSWDFKNKTFLNKVY

SEQ ID NO: 74 - DNA, 1227 bp, Kluyveromyces lactis
atgctatctttgaaagctcaatcctctgtggttgggaagtccagctctttgagattggttagaaacttttctaaaaacgtccgtgctttgtcccaggttgctgatgaaactaagccaggtgatgatgacctagttcaaattgatttgccagaaacctcttttgaaggttatcttttggatgttcctgaattaagttatcaaaccaccaagtccaatttgctacaaatgtacaaggatatgattatcgttagaagaatggaaatggcctgtgacgctttgtacaaggctaagaaaattagaggtttctgtcactcctctgtcggtcaagaagccattgccgttggtattgaaaacgctatcactaagcgtgataccgtcatcacctcttacagatgtcatggtttcacctacatgagaggtgctgctgttcaagctgtgttggctgaattgatgggtagaagaactggtgtgtccttcggtaagggtggttccatgcacttgtacgcccctggtttctacggtggtaatggtatcgttggtgcccaagtcccattgggtgctggtttggccttcgctcatcaatacaaacacgaagatgcttgttcttttgccttgtacggtgatggtgcctctaaccaaggtcaagttttcgaatccttcaacatggccaagttatggaacttaccagccgtcttctgttgtgaaaacaacaagtacggtatgggtaccgctgccgcaagatcttcagccatgactgaatacttcaagcgtggtcaatacattcctggtttgaaggttaacggtatggatatcttggctgttaccaagcttaaggactggactgtctccggtaacggtccaatcgttcttgaatacgaaacttacagatatggtggtcactctatgtctgatccaggtactacttacagaaccagagatgaaatccaacacatgagatctaagaacgatccaattgcaggtttaaagatgcacttattggaattgggtatcgccacggaagatgaaattaaggcttacgacaaggctgctagaaagtacgtcgatgagcaagtcgaattagctgatgctgccccagctccagaagctaagatgtccatcttgttcgaggatgtctacgttccaggttctgaaactccaaccctaagaggtagattgcaagaagatacttgggattttgctaagaagagctttgctttcagagattag

SEQ ID NO: 75 - protein, 408 aa, Kluyveromyces lactis
MLSLKAQSSVVGKSSSLRLVRNFSKNVRALSQVADETKPGDDDLVQIDLPETSFEGYLLDVPELSYQTTKSNLLQMYKDMIIVRRMEMACDALYKAKKIRGFCHSSVGQEAIAVGIENAITKRDTVITSYRCHGFTYMRGAAVQAVLAELMGRRTGVSFGKGGSMHLYAPGFYGGNGIVGAQVPLGAGLAFAHQYKHEDACSFALYGDGASNQGQVFESFNMAKLWNLPAVFCCENNKYGMGTAAARSSAMTEYFKRGQYIPGLKVNGMDILAVTKLKDWTVSGNGPIVLEYETYRYGGHSMSDPGTTYRTRDEIQHMRSKNDPIAGLKMHLLELGIATEDEIKAYDKAARKYVDEQVELADAAPAPEAKMSILFEDVYVPGSETPTLRGRLQEDTWDFAKKSFAFRD

SEQ ID NO: 76 - DNA, 1185 bp, Yarrowia lipolytica
atgctcactgccgctcgacgatctacacggctcaccagccgactcggccaccaggtccgagcatactccatcgctgacgatgccgacaagaaatgcacaatcacgctcaaggaggattcttacaccacctacatgcttgattctccccctcctctcgagttcgagatgaccaagggtgagcttctgcaaatgtacaaggacatggtgaccgtccgacgactcgagatggctgctgatgccctctacaaggccaagaagatccgaggtttctgccatctgtctactggtcaggaggctgttgccgtcggtatcgagaaggccatcgaccacgacgattctgtcatcaccgcctaccgatgccacggtttcgcctacatgcgaggtgcctctgtccgagcaatcatcgccgagctgctcggaaagcgaaccggtgtctcctacggtaagggtggatccatgcacatgttcaccgagggtttctacggaggaaacggtattgtcggagcccaggtccccgtcggagctggtctcgccttcgcccacaagtacctcgagcagaccggaaaggccacctttgccctgtacggtgacggtgcttccaaccagggtcagatcttcgaggcctacaacatggccaagctctgggacctcccctgcatctttgcatgcgagaacaacaagtacggaatgggtaccgctgctgctcgatcctctgccctgacgcagtactacaagcgaggtcagtacattcccggtctcaaggttaacggaatggacattctgtccgtctaccagggagccaagttcgccaaggagtggaccacacacggcaagggtcccctcgtcatggagttcgagacctaccgatacggtggtcactccatgtccgatcccggaaccacctaccgaacccgagaggagatccagtacatgcgatcccacaacgatcctatttctggtctcaaggcccacatcctggagcttaatttcgccactgaggacgagcttaagtctgtggacaaggctgctcgagctatggttgacaaggaggttgcccttgctgagtccgaccctgctcctgaggctactgccaaggttctgtttgaggatatctacgttcccggcaccgagcctcctgtgatccgaggccgaatcccttccgaggactactactttaagaactaa

SEQ ID NO: 77 - protein, 394 aa, Yarrowia lipolytica
MLTAARRSTRLTSRLGHQVRAYSIADDADKKCTITLKEDSYTTYMLDSPPPLEFEMTKGELLQMYKDMVTVRRLEMAADALYKAKKIRGFCHLSTGQEAVAVGIEKAIDHDDSVITAYRCHGFAYMRGASVRAIIAELLGKRTGVSYGKGGSMHMFTEGFYGGNGIVGAQVPVGAGLAFAHKYLEQTGKATFALYGDGASNQGQIFEAYNMAKLWDLPCIFACENNKYGMGTAAARSSALTQYYKRGQYIPGLKVNGMDILSVYQGAKFAKEWTTHGKGPLVMEFETYRYGGHSMSDPGTTYRTREEIQYMRSHNDPISGLKAHILELNFATEDELKSVDKAARAMVDKEVALAESDPAPEATAKVLFEDIYVPGTEPPVIRGRIPSEDYYFKN

SEQ ID NO: 78 - DNA, 1191 bp, Pichia stipitis
atgttacgtactgctgctgttcgtcctcttaagggcggtgttgtcatcgccagaagagccatggcctcgtccagcgacttggtcagcatcgaattgcctgaatcgtcgtttgaaggctacaacttggagatccccgagttgactttcgaaaccgaaaaggaaaccttgttgaagatgtacaaggatatgatcatcatcagaagaatggaaatggcttcagacgccttgtacaaggccaagaagatcagagggttctgccacttgtctgttggtcaagaagccattgccgttggaattgagaacgccattactcctgaagatactgtcatcacctcttacagatgtcacggttttgctttcatgagaggtgcttctgtcaaggaagttctcggagaattgatgggtaagagatctggtgtttcttatggtaaaggtggttctatgcacatgtttgccccaggcttttacggaggaaacggtatcgttggagctcaagttccattgggtgctggtttagctttctcccacaagtacaggggacagaaggctgctgccttcactttgtacggtgacggtgcctccaaccagggacaagttttcgaagcctacaacatggccaagttgtggaacttgccttgtatctttgcctgtgaaaacaacaagtacggtatgggtactgctgctgccagatcctctgctattactgagtactacaagagaggtcaatacattcctggtttgaagatcaacggtatggacgttttggctacctaccaggcttccaagtttgccaaggactgggctgctcaaggcaacggaccattggttttggaatacgaaacctacagatacggtggtcactccatgtctgacccaggtaccacctacagaacaagagaagaagtgcaacacatgagatccagaaacgatcctattgccggcttaaaggctactttgttggacaagggcattgctaccgaagaagaaatcaagtcctatgacaaggctgccagaaagtacgtcgacgaacaagtcgctgctgctgaagctgacgctcctcctgaagccaagatggacatcttattcgaagatgtatatgtcccaggatctgaaatcccagtgttgagaggcagaatctcggacgactcgtgggacttcaagaacaaaactttcttgaacaaggtctactag

SEQ ID NO: 79 - protein, 396 aa, Pichia stipitis
MLRTAAVRPLKGGVVIARRAMASSSDLVSIELPESSFEGYNLEIPELTFETEKETLLKMYKDMIIIRRMEMASDALYKAKKIRGFCHLSVGQEAIAVGIENAITPEDTVITSYRCHGFAFMRGASVKEVLGELMGKRSGVSYGKGGSMHMFAPGFYGGNGIVGAQVPLGAGLAFSHKYRGQKAAAFTLYGDGASNQGQVFEAYNMAKLWNLPCIFACENNKYGMGTAAARSSAITEYYKRGQYIPGLKINGMDVLATYQASKFAKDWAAQGNGPLVLEYETYRYGGHSMSDPGTTYRTREEVQHMRSRNDPIAGLKATLLDKGIATEEEIKSYDKAARKYVDEQVAAAEADAPPEAKMDILFEDVYVPGSEIPVLRGRISDDSWDFKNKTFLNKVY

SEQ ID NO: 80 - DNA, 8946 bp, artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcagcatgctagtgaaggccaagttcgtcaagggctttattagagatgttcatccgtatgggtgtaggagagaagtgttaaaccagattgactactgcaagaaagcaattggctttaggggccctaaaaaggttcttattgtaggtgcttcttcaggcttcggactagctactagaatatctgttgcattcggagggcctgaagcccatacaatcggtgtttcatacgagactggagctacagacagaaggataggtacggctgggtggtacaataatatcttctttaaagaattcgctaagaagaaaggtttggtggcaaagaatttcatagaagatgcattttcgaatgaaaccaaggataaagtgataaagtatataaaggacgaatttggtaaaattgatttattcgtatattctttagctgctcctagaagaaaggactacaaaaccggtaatgtttatacctcaagaattaaaacaattctaggtgactttgaagggcctactattgacgtagaaagagatgaaataactttaaagaaggtatcttctgctagtatcgaggaaatcgaagaaacacgtaaagtaatgggcggagaagactggcaggagtggtgtgaggagttattatacgaagattgtttttctgataaagctacaaccatcgcttattcctatattggcagtcctagaacttataaaatatatcgtgaaggaaccattgggattgctaagaaggatttagaagacaaagccaagttgatcaacgaaaagcttaatagagtcataggaggtagggcatttgtgtctgttaacaaagctttagtaaccaaggcatctgcttatattccaaccttccctctatacgctgccatattatataaagtaatgaaagaaaagaacattcacgaaaattgtattatgcaaattgagcgtatgttctcagagaaaatatactccaacgaaaagattcagttcgatgataagggccgtcttagaatggacgatttagaactaagaaaggatgttcaggatgaagttgacagaatttggtctaacataacaccagaaaacttcaaggagcttagtgactacaaggggtataagaaagagtttatgaatctaaatggttttgatttagatggagttgattattccaaggatcttgatattgaattacttagaaaactagagccttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 81 - DNA, 34 bp, artificial sequence
  primer
tatactcgagaaagaggaagccaagaattgagaa

SEQ ID NO: 82 - DNA, 54 bp, artificial sequence
  primer
ctcgagctgcagttggcgcgcctgttaaaacctctagtggagtagtagatgtaa

SEQ ID NO: 83 - DNA, 8459 bp, artificial sequence
  vector
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctgaggatgtatactgtgggggattacctgctggatcgcctgcacgaactggggattgaagaaattttcggtgtgccaggcgattataacctgcagttcctggaccagattatctcgcacaaagatatgaagtgggtcggtaacgccaacgaactgaacgcgagctatatggcagatggttatgcccgtaccaaaaaagctgctgcgtttctgacgacctttggcgttggcgaactgagcgccgtcaacggactggcaggaagctacgccgagaacctgccagttgtcgaaattgttgggtcgcctacttctaaggttcagaatgaaggcaaatttgtgcaccatactctggctgatggggattttaaacattttatgaaaatgcatgaaccggttactgcggcccgcacgctgctgacagcagagaatgctacggttgagatcgaccgcgtcctgtctgcgctgctgaaagagcgcaagccggtatatatcaatctgcctgtcgatgttgccgcagcgaaagccgaaaagccgtcgctgccactgaaaaaagaaaacagcacctccaatacatcggaccaggaaattctgaataaaatccaggaatcactgaagaatgcgaagaaaccgatcgtcatcaccggacatgagatcatctcttttggcctggaaaaaacggtcacgcagttcatttctaagaccaaactgcctatcaccaccctgaacttcggcaaatctagcgtcgatgaagcgctgccgagttttctgggtatctataatggtaccctgtccgaaccgaacctgaaagaattcgtcgaaagcgcggactttatcctgatgctgggcgtgaaactgacggatagctccacaggcgcatttacccaccatctgaacgagaataaaatgatttccctgaatatcgacgaaggcaaaatctttaacgagcgcatccagaacttcgattttgaatctctgattagttcgctgctggatctgtccgaaattgagtataaaggtaaatatattgataaaaaacaggaggattttgtgccgtctaatgcgctgctgagtcaggatcgtctgtggcaagccgtagaaaacctgacacagtctaatgaaacgattgttgcggaacagggaacttcatttttcggcgcctcatccatttttctgaaatccaaaagccatttcattggccaaccgctgtgggggagtattggttatacctttccggcggcgctgggttcacagattgcagataaggaatcacgccatctgctgtttattggtgacggcagcctgcagctgactgtccaggaactggggctggcgatccgtgaaaaaatcaatccgatttgctttatcatcaataacgacggctacaccgtcgaacgcgaaattcatggaccgaatcaaagttacaatgacatcccgatgtggaactatagcaaactgccggaatcctttggcgcgacagaggatcgcgtggtgagtaaaattgtgcgtacggaaaacgaatttgtgtcggttatgaaagaagcgcaggctgacccgaatcgcatgtattggattgaactgatcctggcaaaagaaggcgcaccgaaagttctgaaaaagatggggaaactgtttgcggagcaaaataaaagctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggcc

SEQ ID NO: 84 - DNA, 115 bp, artificial sequence
  primer
aaaccgctgaggatgttgtctttgagacaatctattagattttttttgccagctactagaactttgtgttcttctagatatttgttgtatactgtgggggattacctgctggatc

SEQ ID NO: 85 - DNA, 22 bp, artificial sequence
  primer
tctctgctgtcagcagcgtgcg

SEQ ID NO: 86 - DNA, 19 bp, artificial sequence
  primer
tctgccatatagctcgcgt

SEQ ID NO: 87 - DNA, 36 bp, artificial sequence
  primer
aatctaaagagctcagcctgccggtaccggcttggc

SEQ ID NO: 88 - DNA, 39 bp, artificial sequence
  primer
ataaggactagtgacaaaacgagaaagaagtcgtgtccg

SEQ ID NO: 89 - DNA, 76 bp, artificial sequence
  primer
gtgagtgctacaagccacatttaaactaagtcaattacacaaagttagtgggtcgcctgacgcatatacctttttc

SEQ ID NO: 90 - DNA, 76 bp, artificial sequence
  primer
attttacctaacaagttgttgcgtaaatttataaagtaaattgtcggtttttttgtgtggtgccctcctccttgtc

SEQ ID NO: 91 - DNA, 33 bp, artificial sequence
  primer
gagtcatctcaaacatatgtctgcagatacttc

SEQ ID NO: 92 - DNA, 31 bp, artificial sequence
  primer
gaaatagctttaagaaccttaatggcttcgg

SEQ ID NO: 93 - DNA, 4280 bp, artificial sequence
  vector
ggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccccggctctgagacagtagtaggttagtcatcgctctaccgacgcgcaggaaaagaaagaagcattgcggattacgtattctaatgttcagcccgcggaacgccagcaaatcaccacccatgcgcatgatactgagtcttgtacacgctgggcttccagtgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcttcagcccgcggaacgccagcaaatcaccacccatgcgcatgatactgagtcttgtacacgctgggcttccagtgatgatacaacgagttagccaaggtgagcacggatgtctaaattagaattacgttttaatatctttttttccatatctagggctag

SEQ ID NO: 94 - DNA, 85 bp, artificial sequence
  primer
ccggctctgagacagtagtaggttagtcatcgctctaccgacgcgcaggaaaagaaagaagcattgcggattacgtattctaatg

SEQ ID NO: 95 - DNA, 86 bp, artificial sequence
  primer
ctagccctagatatggaaaaaaagatattaaaacgtaattctaatttagacatccgtgctcaccttggctaactcgttgtatcatc

SEQ ID NO: 96 - DNA, 22 bp, artificial sequence
  primer
gagaagatgcggccagcaaaac

SEQ ID NO: 97 - DNA, 30 bp, artificial sequence
  primer
cgccaaacaagtttcgggtcaccccacacg

SEQ ID NO: 98 - DNA, 29 bp, artificial sequence
  primer
ctcaaaattctattgtgtttgccggtacc

SEQ ID NO: 99 - DNA, 85 bp, artificial sequence
  primer
cattagaatacgtaatccgcaatgcttctttcttttcctgcgcgtcggtagagcgatcggtgaatgtctggccgaacactaattc

SEQ ID NO: 100 - DNA, 87 bp, artificial sequence
  primer
gatgatacaacgagttagccaaggtgagcacggatgtctaaattagaattacgtttgttaccgctccattagatggtaccattttag

SEQ ID NO: 101 - DNA, 30 bp, artificial sequence
  primer
atagatcgtggaaaactttcactacaaagc

SEQ ID NO: 102 - DNA, 61 bp, artificial sequence
  primer
gaattagtgttcggccagacattcaccgatcgctctaccgacgcgcaggaaaagaaagaag

SEQ ID NO: 103 - DNA, 60 bp, artificial sequence
  primer
ctaaaatggtaccatctaatggagcggtaacaaacgtaattctaatttagacatccgtgc

SEQ ID NO: 104 - DNA, 20 bp, artificial sequence
  primer
cccttggggccgctaattag

SEQ ID NO: 105 - DNA, 30 bp, artificial sequence
  primer
gcattgcggattacgtattctaatgttcag

SEQ ID NO: 106 - DNA, 64 bp, artificial sequence
  primer
cgtcggagggctgtcgcccgctcggcggcttctaatcaccttggctaactcgttgtatcatcac

SEQ ID NO: 107 - DNA, 8156 bp, artificial sequence
  vector
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagcttttctccttgacgttaaagtatagaggtatattaacaattttttgttgatacttttatgacatttgaataagaagtaatacaaactgaaaatgttgaaagtattagttaaagtggttatgcagcttttccatttatatatctgttaatagatcaaaaatcatcgcttcgctgattaattaccccagaaataaggctaaaaaactaatcgcattatcatcctatggttgttaatttgattcgttaatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccgtcggagggctgtcgcccgctcggcggcttctaatagatctatccgc

SEQ ID NO: 108 - DNA, 64 bp, artificial sequence
  primer
gtgatgatacaacgagttagccaaggtgattagaagccgccgagcgggcgacagccctccgacg

SEQ ID NO: 109 - DNA, 37 bp, artificial sequence
  primer
ttttctccttgacgttaaagtatagaggtatattaac

SEQ ID NO: 110 - DNA, 88 bp, artificial sequence
  primer
tgtacacacgtaatcgcgcgtgtacatgtctatatgtgttacttgaactatactgttttggcattgcggattacgtattctaatgttc

SEQ ID NO: 111 - DNA, 97 bp, artificial sequence
  primer
aacagctcctaacccgcggaccaattgtgatggttggcgtttgaatgaagcagcaagcatttttctccttgacgttaaagtatagaggtatattaac

SEQ ID NO: 112 - DNA, 30 bp, artificial sequence
  primer
gattcaggcaactcaatttgcactgtgtcc

SEQ ID NO: 113 - DNA, 753 bp, Saccharomyces cerevisiae
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 114 - DNA, 1662 bp, Lactococcus lactis
tctagacatatgtatactgtgggggattacctgctggatcgcctgcacgaactggggattgaagaaattttcggtgtgccaggcgattataacctgcagttcctggaccagattatctcgcacaaagatatgaagtgggtcggtaacgccaacgaactgaacgcgagctatatggcagatggttatgcccgtaccaaaaaagctgctgcgtttctgacgacctttggcgttggcgaactgagcgccgtcaacggactggcaggaagctacgccgagaacctgccagttgtcgaaattgttgggtcgcctacttctaaggttcagaatgaaggcaaatttgtgcaccatactctggctgatggggattttaaacattttatgaaaatgcatgaaccggttactgcggcccgcacgctgctgacagcagagaatgctacggttgagatcgaccgcgtcctgtctgcgctgctgaaagagcgcaagccggtatatatcaatctgcctgtcgatgttgccgcagcgaaagccgaaaagccgtcgctgccactgaaaaaagaaaacagcacctccaatacatcggaccaggaaattctgaataaaatccaggaatcactgaagaatgcgaagaaaccgatcgtcatcaccggacatgagatcatctcttttggcctggaaaaaacggtcacgcagttcatttctaagaccaaactgcctatcaccaccctgaacttcggcaaatctagcgtcgatgaagcgctgccgagttttctgggtatctataatggtaccctgtccgaaccgaacctgaaagaattcgtcgaaagcgcggactttatcctgatgctgggcgtgaaactgacggatagctccacaggcgcatttacccaccatctgaacgagaataaaatgatttccctgaatatcgacgaaggcaaaatctttaacgagcgcatccagaacttcgattttgaatctctgattagttcgctgctggatctgtccgaaattgagtataaaggtaaatatattgataaaaaacaggaggattttgtgccgtctaatgcgctgctgagtcaggatcgtctgtggcaagccgtagaaaacctgacacagtctaatgaaacgattgttgcggaacagggaacttcatttttcggcgcctcatccatttttctgaaatccaaaagccatttcattggccaaccgctgtgggggagtattggttatacctttccggcggcgctgggttcacagattgcagataaggaatcacgccatctgctgtttattggtgacggcagcctgcagctgactgtccaggaactggggctggcgatccgtgaaaaaatcaatccgatttgctttatcatcaataacgacggctacaccgtcgaacgcgaaattcatggaccgaatcaaagttacaatgacatcccgatgtggaactatagcaaactgccggaatcctttggcgcgacagaggatcgcgtggtgagtaaaattgtgcgtacggaaaacgaatttgtgtcggttatgaaagaagcgcaggctgacccgaatcgcatgtattggattgaactgatcctggcaaaagaaggcgcaccgaaagttctgaaaaagatggggaaactgtttgcggagcaaaataaaagctaaggatcc

SEQ ID NO: 115 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 116 - DNA, 75 bp, Saccharomyces cerevisiae
atgttgtctttgagacaatctattagattttttttgccagctactagaactttgtgttcttctagatatttgttg

SEQ ID NO: 117 - protein, 25 aa, Saccharomyces cerevisiae
MLSLRQSIRFFLPATRTLCSSRYLL

SEQ ID NO: 118 - DNA, 1752 bp, Kluyveromyces lactis
atgctatctcaatcagcagtaagaaggttttctacaactaggaatgttggaaagaagctgaacaaatacagtcatataattaccgaaccaaaggaccagggtgctagtcaagccatgctttatgccactggttttaaggaagacgacttcggtaaagcccaagttggcgtaggttcttgttggtggtctggtaatccgtgtaacatgcatttaatggattttaacaacagaattaccgaaagtgttaacaaagctgggttaaagggaatgcaattcaatactattggtgtctctgatggaatctctatgggaacaaagggaatgagatatagtctacaatcgagggaggttattgcagacagcttcgagacgattatgatggcacagcactatgatgcaaatatcgcgattccttcttgtgataaaaacatgccaggtgtcctaatggctatgggacgtcacaacaggccttcaataatggtttatggaggtactatccttcccggttcccctacatgtggaagtgctaagatccccaaaaagatagatgtcgtcagcgcatttcaatcttacggtcaatatttgtctaaagagtttacggaaactgaaagacaagacgtggtccaacatgcttgtccaggcccaggttcctgcggcggtatgtacactgcaaacacaatggcatccgtcgcagaagtccttggtatgacacttccaaactcgtcctcgttccctgcagtatcgaaagaaaaacttaatgaatgtgacactattggagaagcaataaagaagacaatggagttaggtataacgccacgtgacgttatgaccaaagaagccttcgaaaacgccatgacttatgtaattgctaccggtggaagtactaatgctgttcttcacatggtcgctgttgcgcattccgctggtgtaaagatcaccccagacgactttcagagaatttcggacaaaacgcccttgttgggtgactttaagccttctggcaaatatgttatggccgaccttattactgtcggtggtacacaagcagttattaagtatttatacgaagaaggctttctgcatggcaacacaattactattagcggtgacacactggcggagagagctgccaaagctgtaagtttaaaggatggtcaagacatcattagacctttgaccaatccgatcaaaacttctggacacttgcaaattctgtatggatcactggccccaggtggctcagtaggaaaaataaccggcaaagaagggacttacttcaaaggaaaggcaagggttttcaatgatgaacccggcttcatatccgcattagagaatggtgaaatcaaaaagggtgaaaagaccgtagtcatcattaggtatgagggaccaagaggtggaccaggaatgccagaaatgttgaagccatccagtgccttaatgggttatggtttaggtaaggatgttgctctgttaactgacggtagatttagtggcggttctcacggttttcttattggacatatagtacctgaggcggctgaaggtggtcccatagggttagtgagagacggtgatgagataatcattgatgccgataataacaagatagatttacttgtaccagaagaagaaattgctgagcgtcgtagtacttggactgctccacctccacgttacaccagaggttgtttaagtaaatatgcgaaactggtgagcaatgcctcccacggttgtgtaacggatcttaactaa

SEQ ID NO: 119 - DNA, 141 bp, Saccharomyces cerevisiae
atgcgcagattactgaccggttgccttctttcatctgcacgtcccttgaaatcaagattgccattattgatgtcatcctcattaccttcctctgccggtaagaagcctaaacaagccactttggctagattcttcacttcc

SEQ ID NO: 120 - protein, 47 aa, Saccharomyces cerevisiae
MRRLLTGCLLSSARPLKSRLPLLMSSSLPSSAGKKPKQATLARFFTS

SEQ ID NO: 121 - DNA, 105 bp, Saccharomyces cerevisiae
atggttttgccaagactatatactgctacatcccgtgctgcttttaaagcagccaaacaatccgctccgcttctatccacttcgtggaaaagatgtatggcctca

SEQ ID NO: 122 - protein, 35 aa, Saccharomyces cerevisiae
MVLPRLYTATSRAAFKAAKQSAPLLSTSWKRCMAS

SEQ ID NO: 123 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 124 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 125 - DNA, 1644 bp, Lactococcus lactis
atgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatag

SEQ ID NO: 126 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 127 - DNA, 1650 bp, Staphylococcus epidermidis
atgaaacaacgcgtaggacaatatttaatggacgcggtttattcagcaggtgctgacaaagtttttggtgtcccaggagattttaatctagcctttttagacgatattattgcacataatgatattaaatggattggtaatacaaatgagcttaatgcaagttatgctgccgacggatatgcacgtattaatggcataggtgcaatggtaacaacatttggagtgggtgaattaagtgctgtcaacggaatcgctggatcttatgctgagcgtgtgccagttattgccatcactggggcacctactcgagctgtagaacaagaaggcaaatacgttcaccattcccttggcgaaggaacttttgatgattatagaaaaatgtttgagcctattacaacagcgcaagcttatattacacctgataatgctaccacagaaattccaagagtaatcaatacggcgcttcaacaacgtcgtccagttcacattcatttacctattgatgtcgcactaacagagattgaaatttcaaacccattcaaaccagaagtcgaaccacaaaaaaacgttcaaagttatatcaatatggttcaagacaaacttgaatcggcatcacaacctgtcattattacaggacatgaaataaatagtttccatctgcataaagaactcgaacaattcgttaatcaaactcaaattccagttgttcagttatctttaggtaaaggtgcatttaatgaagaaaatccttattatatgggtatctttgatggttcaatagcagaacaagatattcaagattatgttaatcaaagtgatgctattttgaatattggtgctaaattaacagattctgcaacagctgggttctcatatcaatttgatattaatgaagtgattatgctaaatcataatgaatttaaaattaatgatacatgcatcgaagcattttcattaccaaatatattaaatggtttaaataagtatattcactacaaaaacactaatgatttcccacaatatgagagaccacaatcacacaattacgaacttagtgatcagccattaactcaagagacttatttcaatatgatgcaagattttttacaacaagatgatattttaatcgctgaacaaggtacatcattctttggtgcttatgacttagccttgtacaaagataatacttttatcgggcaaccattatggggatctatcggctatacactaccagcaacgctaggaacacaaattgcaaatccatatcgtcgaaacattctattaattggtgatggatcactacaattaactgttcaatcattatctacaatgattcgtcaaaatttaaaccctgtgatatttgtaattaataacgatggttatacagttgagagaatgattcatggtatgaaagaaccttacaatgacattcgcatgtgggattacaaatcattaccttctgtatttggtggtgacaatgttttagttcatgatgtaaacacttcagaagaactcatgctcaccttcgaaaatattaaatctaatagtgatcgcatgcactttgtagaagtgaaaatggctgttgaagatgcaccagttaaattaagtaatatagctaaagcattcgcatcacaaaacaaatcatcttaa

SEQ ID NO: 128 - protein, 549 aa, Staphylococcus epidermidis
MKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 129 - DNA, 1677 bp, Bacillus cereus
ttgaaaaaacaatatactgtaagtacatatttattggatagactacatgaattaggaattgaacatatatttggggttcctggtgattataatcttgcctttttagatgatgtggtagcacatgaaaatttaaagtggattggcaattgtaacgaattaaatgctgcatatgcagcagatgggtacgctcgcataaaaggaatcgctgctcttattactactttcggtgtcggagaattaagcgccattaacggtattgctggctcatatgcagaaaacgtgccagttataaaaatcacgggtacgccaccaacaaaagtaatggaaaatggagcaatcgtccatcatacgttaggcgatggaaagttcgatcacttttccaatatgtatcgagaaatcactgtggcacaaacaaatgtaacacctgagcatgcagctgaggaaattgaccgtgtattacgtgcatgttggaatgaaaaacgccctgttcatattaatttgccaattgatgtgtataataaaccaattaataaaccgacagaacctattataaataaacctattttaagtaataaagaagcattaaataaaatgcttctacatgccatttcaaaaataaatagtgccaaaaaacctgttattttagctgattttgaagtagatcgatttcacgctaaagaaaatttacatcaattcgtagaaaaaactgggtttcccatcgcgacgttaagtatgggaaaaggaatattcccagaaaaacaccctcaatttatagggatttatactggtgatgtaagttctccgtacttgcgaaaaagaattgatgaatctgattgtattattagtattggtgtgaagttaactgatactattacaggcggcttcacacaaggttttacaaaagaacaagttatagaaatccatccctacactgtgaaaattatagataaaaaatacggtccagttgtaatgcaggatgttttacaacatttaagtgattcaattgagcatcgtaataaagatacccttgacgttaagccatttattttagaatcctcaccttttactgaagagttcattccaaaagcacaaatggtcacacaaaaacgtttttggcagcaaatgtaccatttcttacaagaaaacgacgtcttaattgtagagcaaggaacacctttctttggtagttctgctatccctctacctaataacactgcatatgtaggacaaccgttatggggatctatcggatatacactgcccgctctacttggtacacagctcgccaatttatcacggcgcaacattttaattattggtgatggttctttccaagtaactgcccaagagttatcaactatattacgtcaaaatttaaaaccaattatatttttaatcaataacaacggatacactgttgaacgtgccattcacggccaaaaccaactttataatgatatacaaatgtgggattataataaactatcaatggtatttggggcagaagaaaaaagtctaacatttaaagtagaaaatgaagcagaattagcagcagtcttaacaaatataacttttaataagaatcaacttatctttattgaagttataatgagccaaagcgatcaacctgaattgttagctaaacttggaaaaagatctggtcagcaaaattcttaa

SEQ ID NO: 130 - protein, 558 aa, Bacillus cereus
MKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSSAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGAEEKSLTFKVENEAELAAVLTNITFNKNQLIFIEVIMSQSDQPELLAKLGKRSGQQNS

SEQ ID NO: 131 - DNA, 1665 bp, Clostridium acetobutyricum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 132 - protein, 554 aa, Clostridium acetobutyricum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 133 - DNA, 1668 bp, Pectobacterium atrosepticum
atgagcgaaaattatacggtgggcgattatttactggatcgcctgacacagatcggcattcagcatctcttcggcgtaccgggtgattacaacctgcactttctcgatcatgtcatcagaaacccagatattacctgggtgggctgcgcgaacgagttaaacgcagcttacgctgctgatggctatgcacgatgtcgcccggcagcggcgctgctcaccactttcggcgtcggtgaactcagcgcgattaacggcattgcgggcagctacgcggaatgcctacctgtcatccacattgccgcagcgccctgtctcgcttcacaacgcaatggcgaattactccatcacacattaggagacggtgactttagccacttttcccgcatggcggcagaagtcaccgttgcccaagccagcctcaccgtcgaaaacgcaaccgcagagatcgacagagtgattggtgaagccctcgctcagcacaaaccggtctacctgtttctaccagtagacgtggcggcagcacctgtcggtgcacgaccctatccgctggttatccctgaaccattacactctgatgattcgctacgcgcctttaccaccgctgccaccgatatgctgagcaaggcaaaatcagtctcgttgctggcagattttctggctcaacgctttagcctcgcggggaaaatccaacgctggcttgataaaacaccgcttccccacgccactttgctgatgggaaaaggcacgctaaacgaacagcaccgcagctttaccggaacctactcaggcagcggcagtcacgaatcaatccgagcgcacatcgaagatgcggatgccatcatcagcatcggcgtgcgttataccgatacgattaccaccggttttagccatcagattccgatcgaaaaaaatatcgatattcagccaacgctggctcgcgtagggaatcaggttttcccctccgttcccatgtcagacgctatcgcagtgctggaaaaaatcacagaaaaattcgcctcccgctgggatcactgcaccattacgcctccggttttaccgcaatcggaacacagaagcgcactcagtcagcgcgagttttggcaacagatacagcgtttcctccgccctgacgatatcctcgtcaccgatcaaggcacctcctgttttggtgccgctacgctccggttaccagcgggctgtcatttcatcgtccaaccgctgtgggggtcgataggctattctctgccagccgcattcggcgcacagattgccgaacccgaaagacgcgtggttctgttgatcggcgatggctcacttcagctcaccgtacaggagttgggttctatcattcgggatcgcttgaatatggtcattgtggtgctgaataacgaaggctacaccgtcgaacgcgctattcacggctcggaacagcgctataacgatattgcggcctggaactggacacaacttcctaccgcgctgggcgcaaatgaaaacgagatactctgcaagcaggtgcgttcacccatcgcgctcgcgcaggtacttgagcaagtgaacgcggaatctcgcttgtcactcatagaggtggtattgccgagaatggatatcccagcgctcttacacaccatcacgcaatcgcttgagacacgcaacaccgtgcagtaa

SEQ ID NO: 134 - protein, 555 aa, Pectrobacterium atrosepticum
MSENYTVGDYLLDRLTQIGIQHLFGVPGDYNLHFLDHVIRNPDITWVGCANELNAAYAADGYARCRPAAALLTTFGVGELSAINGIAGSYAECLPVIHIAAAPCLASQRNGELLHHTLGDGDFSHFSRMAAEVTVAQASLTVENATAEIDRVIGEALAQHKPVYLFLPVDVAAAPVGARPYPLVIPEPLHSDDSLRAFTTAATDMLSKAKSVSLLADFLAQRFSLAGKIQRWLDKTPLPHATLLMGKGTLNEQHRSFTGTYSGSGSHESIRAHIEDADAIISIGVRYTDTITTGFSHQIPIEKNIDIQPTLARVGNQVFPSVPMSDAIAVLEKITEKFASRWDHCTITPPVLPQSEHRSALSQREFWQQIQRFLRPDDILVTDQGTSCFGAATLRLPAGCHFIVQPLWGSIGYSLPAAFGAQIAEPERRVVLLIGDGSLQLTVQELGSIIRDRLNMVIVVLNNEGYTVERAIHGSEQRYNDIAAWNWTQLPTALGANENEILCKQVRSPIALAQVLEQVNAESRLSLIEVVLPRMDIPALLHTITQSLETRNTVQ

SEQ ID NO: 135 - DNA, 1662 bp, Serratia proteamaculans
atgaatacgacctatagagtggctgattacctactcgatcgtttggctcagatcggcatccgacatttctttggcgtgccgggtgactacaacctgcagtttctcgatcatgtcatcagtcatccgcaaattacctgggtaggctgcgctaatgaactcaatgctgcctatgccgcagatggttacgcacgctgtaaaccggccgccgctttattgaccacctttggcgtgggcgaactgagcgcgctcaacggtattgccggcagctacgccgaatatctgccggtgatccacgtggtgggtgcgccaacgttacgcgcgcagcgggccggtgatttgttgcaccattcgctgggggacggtgactttggccactttgcccgtatggcgaaagaggtgaccgtcgcgcaggccagcctaacccccgacaacgccgaggcggaaatcgaccgcctgctgaccatcgcgctgtttgagcaccgcccggtctatatagtgttacccagtgaggtggcggaagcaccgttggcatcccggcctgcgccgctggtgttacggcaggcgcatctttcccaggcgtcgctgcaagcttttatcgccgccgcgcggcaaatgctgttaccggccaggcgggtttccctgctggcggattttttggcggaacgttttggggcggaaaaagtgctggaacaatggatgaatgaggttgagataccgcattcaaccatgctgctgggcaagagtgtattggatgaaacccatgcctgctttaccggcacttacgccggtgccgccagcgatccacaggtgaagcaactgattgaaggggccgatgtggtgattaacgtcggcgtgcgctttaccgataccattaccgccggtttcagccatcatctgcctgcggaaaaatgcattgatcttcagccgtttgaagcacgggtagggcagcaggtatttagccaaatcccgctgcgtgatgcggtaatagcactgcaccagttgacgctatcgttggcaaaacaatggccagtaccggccattaaacgcccgacgttgcccgatccgaacggcagcggcctggatcagcacggtttttggcaacagatacaggactttctgcgcccgggcgatattttgatcgccgaacagggcaccgcctgctttggtgctgcggctcttggcctgccgcaaggctgccggtttatcgtccagtcgctgtggggctctatcggttacaccctgccggcggcgttcggtgcacaaacggcggagccggatcggcgggtggtgttgctgatcggcgatggttcggctcagctcacggcgcaggaactgggttcgatgctgcgtgatggacaaaagccggtgatcttcctgctcaataatgaggggtataccgttgaacgggccattcacggcccgcaacagcgttacaacgacatcgcccagtggaactggacgcagttaccgcaggcgctggcgggcgagcatcaggtgaaaacgctgcgggtcgccgatccgcagcagttgcgtcaggcgctgaaagaagttggcgacagcccacaactggcctttgtggaagtgatgctgccgaagatggatattcccgaactgctcgatagcgtttcacgcgccattcactcgcgtaacgcggccgcctga

SEQ ID NO: 136 - protein, 553 aa, Serratia proteamaculans
MNTTYRVADYLLDRLAQIGIRHFFGVPGDYNLQFLDHVISHPQITWVGCANELNAAYAADGYARCKPAAALLTTFGVGELSALNGIAGSYAEYLPVIHVVGAPTLRAQRAGDLLHHSLGDGDFGHFARMAKEVTVAQASLTPDNAEAEIDRLLTIALFEHRPVYIVLPSEVAEAPLASRPAPLVLRQAHLSQASLQAFIAAARQMLLPARRVSLLADFLAERFGAEKVLEQWMNEVEIPHSTMLLGKSVLDETHACFTGTYAGAASDPQVKQLIEGADVVINVGVRFTDTITAGFSHHLPAEKCIDLQPFEARVGQQVFSQIPLRDAVIALHQLTLSLAKQWPVPAIKRPTLPDPNGSGLDQHGFWQQIQDFLRPGDILIAEQGTACFGAAALGLPQGCRFIVQSLWGSIGYTLPAAFGAQTAEPDRRVVLLIGDGSAQLTAQELGSMLRDGQKPVIFLLNNEGYTVERAIHGPQQRYNDIAQWNWTQLPQALAGEHQVKTLRVADPQQLRQALKEVGDSPQLAFVEVMLPKMDIPELLDSVSRAIHSRNAAA

SEQ ID NO: 137 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 138 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 139 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 140 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 141 - DNA, 1476 bp, Bacillus subtilis; identical to SEQ ID NO: 137

SEQ ID NO: 142 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 143 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 144 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 145 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 146 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 147 - DNA, 1014 bp, Pseudomonas aeruginosa
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 148 - protein, 338 aa, Pseudomonas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 149 - DNA, 1014 bp, Pseudomonas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 150 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 151 - DNA, 1200 bp, Candida glabrata
atgatcagagctcaagcttccagattgatctgcaactctcgtgttatcacttccaagagaacttttgccttggctgcccgtgctgcttctatgagaccagctgcttccttgatggctcaaaagtctatcaagccaattgtcgctactcgtggtatcaagcaaattaacttcggtggtaccgttgaaactgtgtacgaacgtgctgactggccacgtgagaagttgttgaactacttcgccaacgacactttcgctttgatcggttacggttcccaaggttacggtcaaggtttgaacctaagagacaacggtctaaacgtcatcattggtgtccgtaaggacggtgcctcttggaaggctgccattgaagacggttgggtcccaggtgagaacttgttcgaagttgaagaagccgtcaagaagggtacttacgtcatgaacttgttgtctgacgctgctcaatccgagacctggaactctttgaagcctctattgaccaagggtaagactttgtacttctcccacggtttctctccagtcttcaaggacttgacccacgttgagccaccaaaggacatcgatgtcatcttggtcgctccaaagggttccggtagaaccgtcagatctttgttcaaggaaggtcgtggtatcaactcctcttacgctgtctggaacgatgtttccggtaaggcccacgaaaaggctcaagctttggctgtcgccgtcggttccggttacgtctaccaaaccactttcgaaaaggaagtcaacagtgacttgtacggtgaaagaggttgtctaatgggtggtatccacggtatgttcttggctcaatacgaagtcctaagagagaacggtcactccccaagtgaagccttcaacgaaaccgtcgaagaagctactcaatccttgtacccattgatcggtaagtacggtatggactacatgtacgatgcttgttccaccactgctagacgtggtgctttggactggtacccaatcttcaaggacgccttgaagcctgtcttccaagacctatacgaatctaccaagaacggtagtgaaaccaagagatccttggaattcaactctcaaccagactacagagagaagctagaatctgaattgcaaaccatcagagacatggaaatatggagagttggtaaggaagtcagaaagttgagaccagaaaaccaataa

SEQ ID NO: 152 - protein, 399 aa, Candida glabrata
MIRAQASRLICNSRVITSKRTFALAARAASMRPAASLMAQKSIKPIVATRGIKQINFGGTVETVYERADWPREKLLNYFANDTFALIGYGSQGYGQGLNLRDNGLNVIIGVRKDGASWKAAIEDGWVPGENLFEVEEAVKKGTYVMNLLSDAAQSETWNSLKPLLTKGKTLYFSHGFSPVFKDLTHVEPPKDIDVILVAPKGSGRTVRSLFKEGRGINSSYAVWNDVSGKAHEKAQALAVAVGSGYVYQTTFEKEVNSDLYGERGCLMGGIHGMFLAQYEVLRENGHSPSEAFNETVEEATQSLYPLIGKYGMDYMYDACSTTARRGALDWYPIFKDALKPVFQDLYESTKNGSETKRSLEFNSQPDYREKLESELQTIRDMEIWRVGKEVRKLRPENQ

SEQ ID NO: 153 - DNA, 1194 bp, Kluveromyces lactis
atgttcagacaagctgctagacaattgattgctaactctcgtgttatcactgctaagagagctatctctttcgctgccagacaatctactgtctctggtttgcgttctactgcctttgcttccaagccattggttgctaccaggggtatcaagcaaatcaactttggtggtgttgaagaaaccgtctacgaaagagctgactggccaaccgaaaaattgttgcaatacttcaaggacgacactttggctttgattggttacggttctcaaggttacggtcaaggtttgaacttgagagacaacggtttgaacgtcattgtcggtgtcagaaagaatggtgcttcttggaaggctgccattgaagacggttgggtcccaggtgaaaacttgttcgacgttaacgaagccgtccaaaagggtaccatcgtcatgaacttgttgtctgacgctgctcaatccgaaacctggtcctctttgaagccattgttgactaagggtaagactttgtacttctcccacggtttctccccagtcttcaaggacttgacccacgttgaaccaccaactgatatcgatgtcatcttggtcgctccaaagggttccggtagaactgtcagatctttgttcaaggaaggtagaggtattaactcctcttacgccgtctggaacgatgtcaccggtaaggctcacgaaaaagctcaggctttggccgtcgctgtcggttccggttacgtctaccaaaccactttcgaaaaggaagtcaactctgacttgtacggtgaaagaggttgtctaatgggtggtattcacggtatgttcttggctcaatacgaagtcttgagagaaaacggtcactccccatctgaagctttcaacgaaactgtcgaagaagctacccaatctctatacccattgatcggtaagtacggtatggattacatgtacgatgcttgttctactactgctagaagaggtgctttggactggtacccaatcttcaaggatgctttgaagccagtcttccaagacttgtacgaatctaccaagaacggttctgaaactaagagatctttggaattcaactctcaaccagactacagagaaaagttggaagctgaactacaaatcatcagaaacatggaaatctggaaggttggtaaggaagtcagaaagttgagaccagaaaacaactag

SEQ ID NO: 154 - protein, 397 aa, Kluyveromyces lactis
MFRQAARQLIANSRVITAKRAISFAARQSTVSGLRSTAFASKPLVATRGIKQINFGGVEETVYERADWPTEKLLQYFKDDTLALIGYGSQGYGQGLNLRDNGLNVIVGVRKNGASWKAAIEDGWVPGENLFDVNEAVQKGTIVMNLLSDAAQSETWSSLKPLLTKGKTLYFSHGFSPVFKDLTHVEPPTDIDVILVAPKGSGRTVRSLFKEGRGINSSYAVWNDVTGKAHEKAQALAVAVGSGYVYQTTFEKEVNSDLYGERGCLMGGIHGMFLAQYEVLRENGHSPSEAFNETVEEATQSLYPLIGKYGMDYMYDACSTTARRGALDWYPIFKDALKPVFQDLYESTKNGSETKRSLEFNSQPDYREKLEAELQIIRNMEIWKVGKEVRKLRPENN

SEQ ID NO: 155 - DNA, 1185 bp, Ashbya gossypii
atgttcagagcagcaggcagacagatgattgcgggcacgcgcgcggcggcgtggcgcgcgctctccggcgcgcgggcacgcgcggccatgcggccggtgcgcagcgcgcgggcggcgccgctggtgcagtcacgtggtgtgaagcaaatcagcttcggcggcacgcccgagacggtgtacgagcgggcagactggccgcgggagaagctgctggagtacttcaagaacgacacgctggcactgatcgggtacgggtcgcaggggcacgggcagggcctgaacctgcgcgacaccgggctcaaggtggtggtgggcgtgcgcaagggcggcgcgtcgtggaaggcggcggtcgaggacgggtgggtgccgggcgagaacctgttcgacgtggtggaggccgtggagcgcggcacgatcgtgatgaacctgctgtcggacgcggcgcagtctgagacgtggcccacgctgcggccgctgctgacgcccggcaagacgctgtacttctcgcacgggttctcgccggtgttcaaggacctgacgcacgtggagccgcctaaggacatcgacgtgatcctggtggcgcccaagggctcggggcgcaccgtgcgctcgctgttcctggaggggcgcggcatcaactcgtcgtacgcggtgtggaacgacgcgaccggccgcgcgcacgagaaggcgcaggcgctggccgtcgccgtcggctccggctacgtctacgagacgaccttcgagaaggaggtcaactccgacctgtacggcgagcgcggctgcctgatgggcggcatccacggcatgttcctcgcgcagtacgaagtgctgcgcgagaacggccactccgccttcgaggccttcaacgagactggcgaggaggccacgcagtcgctggacccgctgatcggcaagcacggcatggactacatgtacgacgcctgctccacgaccgcgcgccgcggcgcgctcgactggtacccgatcttcaagaacgcgctcaagcccgtgttccgcgatctctacgagtccacgcgcaacggctccgagaccaaacgctccctggagttcaactcccagcccgactaccgcgacaaactcgaggccgagctccagaccatccgcgacatggagatctggaaggtcgggaaggaggtccgcaagctgcgccccgagaacaactga

SEQ ID NO: 156 - protein, 394 aa, Ashbya gossypii
MFRAAGRQMIAGTRAAAWRALSGARARAAMRPVRSARAAPLVQSRGVKQISFGGTPETVYERADWPREKLLEYFKNDTLALIGYGSQGHGQGLNLRDTGLKVVVGVRKGGASWKAAVEDGWVPGENLFDVVEAVERGTIVMNLLSDAAQSETWPTLRPLLTPGKTLYFSHGFSPVFKDLTHVEPPKDIDVILVAPKGSGRTVRSLFLEGRGINSSYAVWNDATGRAHEKAQALAVAVGSGYVYETTFEKEVNSDLYGERGCLMGGIHGMFLAQYEVLRENGHSAFEAFNETGEEATQSLDPLIGKHGMDYMYDACSTTARRGALDWYPIFKNALKPVFRDLYESTRNGSETKRSLEFNSQPDYRDKLEAELQTIRDMEIWKVGKEVRKLRPENN

SEQ ID NO: 157 - DNA, 1200 bp, Pichia stipitis
atgtccttcagaagatcttccctccgtatggccaagatggcctctgctgctgcctccaagcagattgcttctaagagagccatgtctgctttggcttctgctgctaagcctgttgtttccaagcaatcgatggccccactcgctgtccgtggtatcaagaccatcaactttggtggcactgaagaagttgtccatgaaagagccgactggccaagagaaaagttgttggaatacttcaagaacgacaccttagccttgattggttacggttctcaaggttacggccaaggtttgaacttgagagacaacggtttgaacgtcatcattggtgtcagaaagaacggtgcctcttggaaggctgccattgaagatggctgggttccaggtgaaaacttgtttgacgtcaacgaagctatttccaagggtacctacatcatgaacttgctttctgatgctgctcaatctgaaacttgggcttctatcaagcctcagcttaccgaaggcaagactttgtacttctctcacggtttctctccagttttcaaggaattgacccatgttgaacctccaaccaacattgatgttatcttggctgctccaaagggttccggtagaaccgtcagatccttgttcaaggaaggtagaggtatcaactcttcttacgctgtgtggaacgacgtcactggtaaggccgaagaaaaggctattgccttggctgttgccattggttccggttacgtttaccaaaccacttttgaaagagaagtcaactctgacttgtacggtgaaagaggttgtttgatgggtggtatccacggtatgttcttggctcaatacgaagttttgagagaaaacggacacactccatctgaagctttcaacgaaactgtcgaagaagccacccaatctttgtacccattgattggtaagtacggtatggactacatgtacgatgcttgttctaccactgccagaagaggtgctttggactggtacccaagattcaaggatgccttgaagccagtcttcaacgacttgtacgaatcggtcaagaacggttccgaaactcagagatccttagacttcaactctcaacctgactacagagaaaagttggaagaagaattgcaagtcatcagaaacatggaaatctggagagttggtaaggaagtcagaaagttgcgtccagaaaaccaataa

SEQ ID NO: 158 - protein, 399 aa, Pichia stipitis
MSFRRSSLRMAKMASAAASKQIASKRAMSALASAAKPVVSKQSMAPLAVRGIKTINFGGTEEVVHERADWPREKLLEYFKNDTLALIGYGSQGYGQGLNLRDNGLNVIIGVRKNGASWKAAIEDGWVPGENLFDVNEAISKGTYIMNLLSDAAQSETWASIKPQLTEGKTLYFSHGFSPVFKELTHVEPPTNIDVILAAPKGSGRTVRSLFKEGRGINSSYAVWNDVTGKAEEKAIALAVAIGSGYVYQTTFEREVNSDLYGERGCLMGGIHGMFLAQYEVLRENGHTPSEAFNETVEEATQSLYPLIGKYGMDYMYDACSTTARRGALDWYPRFKDALKPVFNDLYESVKNGSETQRSLDFNSQPDYREKLEEELQVIRNMEIWRVGKEVRKLRPENQ

SEQ ID NO: 159 - DNA, 1197 bp, Yarrowia lipolytica
atgtctgcccgacttttctccactgcctctcgacaggctgctcgagccgccgttgcccgagtggccaccgtgtctgcctcccgatccatctccatggctgctacccgacccgccttcaagctgtccgcccccgccgtggcccgaaccatcaagaccatctccttcaacggaaaggaggacgagattgtccacgagcgagccgactggccccaggagaagctgctcgactacttcaagaacgacaccattgctctgatcggctacggctcccagggctacggccagggtctcaacatgcgagacaacggcctcaacgtcatcatcggagtccgaaaggacggcgcctcgtggaaggccgctcaggaggacggctgggtccccggcaagaacctctttgacgtcaacgaggccattggcaagggaactatcatcatgaacctgctgtccgacgccgcccagtccgagacctggccccagatcaagcccctcatcaccaagggcaagactctctacttctcccacggcttctcccccgtcttcaaggatctgactaaggtcgagacccccgccgacgttgacgtcatcctcgtggcccccaagggatccggccgaaccgtccgatctctgttcaaggagggacgaggtatcaactcctcttacgccgtgtggaacgacgtcaccggcaaggccgacgagaaggccgttgccctcgccattgccgtcggctctggctacgtctaccagaccacttttgagaaggaggtccgatccgatctctacggagagcgaggctgcctcatgggcggtatccacggcatgttccttgcccagtacgaggttctgcgagagcgaggccactctccctccgaggccttcaacgagaccgtcgaggaggccacccagtctctctaccctctgatcggcaagtacggtatggactacatgtacgatgcctgctccaccactgcccgacgaggagctctcgactggtcccccaagttcaaggacgccctcaagcccgttttcaacgagctctacgaccgagtcgaggacggttccgagacccagcgatctctggagttcaactcccagaaggactaccgagccaagttcgaggccgagctgcaggacatccgagatctcgagatctggcgagtcggcaaggaggtccgaaagctgcgacccgagaacaactaa

SEQ ID NO: 160 - protein, 398 aa, Yarrowia lipolytica
MSARLFSTASRQAARAAVARVATVSASRSISMAATRPAFKLSAPAVARTIKTISFNGKEDEIVHERADWPQEKLLDYFKNDTIALIGYGSQGYGQGLNMRDNGLNVIIGVRKDGASWKAAQEDGWVPGKNLFDVNEAIGKGTIIMNLLSDAAQSETWPQIKPLITKGKTLYFSHGFSPVFKDLTKVETPADVDVILVAPKGSGRTVRSLFKEGRGINSSYAVWNDVTGKADEKAVALAIAVGSGYVYQTTFEKEVRSDLYGERGCLMGGIHGMFLAQYEVLRERGHSPSEAFNETVEEATQSLYPLIGKYGMDYMYDACSTTARRGALDWSPKFKDALKPVFNELYDRVEDGSETQRSLEFNSQKDYRAKFEAELQDIRDLEIWRVGKEVRKLRPENN

SEQ ID NO: 161 - DNA, 1215 bp, Schizosaccharomyces pombe
atgtctttccgtaattcctctagaatggccatgaaggccttgcgtactatgggtagccgtcgtttggctactcgtagcatgtctgttatggctcgcaccattgctgcccccagcatgcgttttgcgcctcgcatgaccgcccctttgatgcaaactcgcggtatgcgtgttatggactttgccggtaccaaggagaacgtttgggagcgttctgactggcctcgtgaaaagcttgttgactacttcaagaacgacactcttgccatcattggatacggatctcaaggacatggtcaaggtttgaacgctcgtgatcaaggtttgaacgttattgtcggtgtccgtaaggatggtgcttcctggaagcaagctattgaagacggttgggtccctggtaagactttgttccccgtcgaggaggccatcaagaagggttctatcatcatgaaccttttgtccgatgccgctcaaactgagacttggcccaagattgctccccttattaccaagggtaagactttgtacttctctcacggtttctccgtcatcttcaaggatcaaactaagattcacccccctaaggatgttgatgttatccttgtcgctcccaagggttctggtcgtaccgttcgtacccttttcaaggaaggtcgtggtattaactcttccttcgctgtttaccaagacgttactggtaaggctcaagaaaaggccattggtttggctgttgccgtcggttccggtttcatctaccaaaccactttcaagaaggaggttatctccgatttggttggtgagcgtggatgtctcatgggtggtatcaacggtcttttcttggctcaataccaagttttgcgtgaacgtggtcactcccctgctgaggctttcaacgagactgttgaagaggccactcaatccctttaccccttgattggcaagtacggtcttgactacatgtttgccgcttgctctaccaccgctcgtcgtggtgccattgactggactcctcgtttccttgaggctaacaagaaggtccttaatgaattgtatgacaatgttgagaacggtaacgaggctaagcgttccttggaatacaactctgctcccaactaccgtgagctttacgataaggagttggaggaaatccgcaacttggaaatctggaaggctggtgaggttgttcgttctctccgtcctgaacacaacaagcactag

SEQ ID NO: 162 - protein, 404 aa, Schizosaccharomyces pombe
MSFRNSSRMAMKALRTMGSRRLATRSMSVMARTIAAPSMRFAPRMTAPLMQTRGMRVMDFAGTKENVWERSDWPREKLVDYFKNDTLAIIGYGSQGHGQGLNARDQGLNVIVGVRKDGASWKQAIEDGWVPGKTLFPVEEAIKKGSIIMNLLSDAAQTETWPKIAPLITKGKTLYFSHGFSVIFKDQTKIHPPKDVDVILVAPKGSGRTVRTLFKEGRGINSSFAVYQDVTGKAQEKAIGLAVAVGSGFIYQTTFKKEVISDLVGERGCLMGGINGLFLAQYQVLRERGHSPAEAFNETVEEATQSLYPLIGKYGLDYMFAACSTTARRGAIDWTPRFLEANKKVLNELYDNVENGNEAKRSLEYNSAPNYRELYDKELEEIRNLEIWKAGEVVRSLRPEHNKH

SEQ ID NO: 163 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 164 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 165 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 166 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 167 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 168 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 169 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 170 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 171 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 172 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 173 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 174 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 175 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 176 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 177 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 178 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 179 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 180 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 181 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 182 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 183 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 184 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 185 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 186 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 187 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 188 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 189 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 190 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 191 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 192 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 193 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 194 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 195 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 196 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 197 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 198 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 199 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 200 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 201 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 202 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 203 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 204 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 205 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 206 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 207 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 208 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 209 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 210 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 211 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 212 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 213 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 214 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 215 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 216 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 217 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 218 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 219 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 220 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 221 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 222 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 223 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 224 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 225 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 226 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 227 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 228 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 229 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 230 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 231 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 232 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 233 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 234 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 235 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 236 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 237 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 238 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 239 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 240 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 241 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 242 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 243 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 244 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 245 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 246 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 247 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 248 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 249 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 250 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 251 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 252 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 253 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 254 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 255 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 256 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 257 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 258 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 259 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 260 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 261 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 262 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 263 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 264 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 265 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 266 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 267 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 268 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 269 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 270 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 271 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 272 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 273 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 274 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 275 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 276 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 277 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 278 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 279 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 280 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 281 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 282 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 283 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 284 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 285 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 286 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 287 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 288 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 289 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 290 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 291 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 292 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 293 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 294 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 295 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 296 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 297 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 298 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 299 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 300 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 301 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 302 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 303 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 304 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 305 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 306 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 307 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 308 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 309 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 310 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 311 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 312 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 313 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 314 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 315 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 316 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 317 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 318 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 319 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 320 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 321 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 322 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 323 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 324 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 325 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 326 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 327 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 328 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 329 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 330 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 331 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 332 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 333 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 334 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 335 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 336 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 337 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 338 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 339 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 340 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 341 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 342 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 343 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 344 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 345 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 346 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 347 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 348 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 349 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 350 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 351 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 352 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 353 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 354 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 355 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 356 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 357 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 358 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 359 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 360 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 361 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 362 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 363 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 364 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 365 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 366 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 367 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 368 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 369 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 370 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 371 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 372 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 373 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 374 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 375 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 376 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 377 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 378 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 379 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 380 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 381 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 382 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 383 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 384 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 385 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 386 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 387 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 388 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 389 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 390 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 391 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 392 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 393 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 394 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 395 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 396 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 397 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 398 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 399 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 400 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 401 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 402 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 403 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 404 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 405 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 406 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 407 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 408 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 409 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 410 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 411 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 412 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 413 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 414 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 415 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 416 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 417 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 418 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 419 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 420 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 421 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 422 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 423 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 424 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 425 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 426 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 427 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 428 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 429 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 430 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 431 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 432 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 433 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 434 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 435 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 436 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 437 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 438 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 439 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 440 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 441 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 442 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 443 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 444 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 445 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 446 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 447 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 448 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 449 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 450 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 451 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 452 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 453 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 454 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 455 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 456 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 457 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 458 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 459 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 460 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 461 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 462 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 463 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 464 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 465 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 466 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 467 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 468 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 469 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 470 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 471 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 472 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 473 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 474 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 475 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 476 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 477 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 478 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 479 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 480 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 481 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 482 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 483 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 484 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 485 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 486 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 487 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 488 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 489 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 490 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 491 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 492 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 493 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 494 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 495 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 496 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 497 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 498 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 499 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 500 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 501 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 502 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 503 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 504 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 505 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 506 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 507 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 508 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 509 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 510 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 511 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 512 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 513 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 514 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 515 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 516 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 517 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 518 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 519 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 520 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 521 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 522 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 523 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 524 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 525 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 526 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 527 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 528 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 529 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 530 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 531 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 532 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 533 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 534 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 535 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 536 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 537 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 538 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 539 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 540 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 541 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 542 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 543 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 544 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 545 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 546 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 547 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 548 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 549 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 550 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 551 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 552 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 553 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 554 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 555 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 556 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 557 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 558 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 559 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 560 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 561 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 562 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 563 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 564 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 565 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 566 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 567 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 568 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 569 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 570 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 571 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 572 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 573 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 574 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 575 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 576 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 577 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 578 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 579 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 580 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 581 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 582 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 583 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 584 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 585 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 586 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 587 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 588 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 589 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 590 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 591 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 592 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 593 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 594 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 595 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 596 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 597 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 598 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 599 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 600 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 601 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 602 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 603 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 604 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 605 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 606 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 607 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 608 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 609 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 610 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 611 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 612 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 613 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 614 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 615 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 616 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 617 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 618 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 619 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 620 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 621 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 622 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 623 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 624 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 625 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 626 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 627 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 628 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 629 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 630 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 631 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 632 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 633 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 634 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 635 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 636 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 637 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 638 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 639 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 640 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 641 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 642 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 643 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 644 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 645 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 646 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 647 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 648 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 649 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 650 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 651 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 652 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 653 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 654 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 655 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 656 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 657 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 658 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 659 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 660 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 661 - DNA, 1836 bp, Agrobacterium tumefaciens
atgccagcctatcgctccagaacgacaacccacggccgcaacatggcgggcgcgcgcggcctttggcgcgccaccggcatgaaggacagcgatttcggcaagccgatcatcgcggtggtcaattccttcacgcagttcgtaccgggccatgtgcatctaaaggatctcggccagctcgttgcccgcgaaatcgaggcggccggcggcgttgccaaggaattcaacacgattgcggtcgatgatggtatcgccatgggccatgacggcatgctctattcgctgccgtcgcgcgagatcatcgctgactcggtcgaatatatggtcaatgcccattgcgccgatgcgatggtctgcatttccaactgcgacaagatcacgcccggcatgctgaatgccgcgatgcgcctcaacattcccgccgttttcgtgtccggtggtccaatggaagcgggcaaggtggttctgcacggcaagaccgttgcgctcgatctggtcgacgcgatggtggctgctgccgacgacaagatttccgatgaggacgtcaagatcatcgagcgctccgcctgcccgacctgcggttcctgttccggcatgttcacggccaattccatgaactgtctgaccgaggcgctcggcctgtcattgcccggcaacggctcgacgcttgccacccactccgatcgcaagcgcctgttcgttgaagccggtcacctgatcgtcgatctggcccgccgttattacgagcaggacgacgaaaccgttctgccgcgcaccatcgccaacaaggcggcgttcgaaaacgccatgtcgctggatattgccatgggcggctccaccaacacggttctgcatattctggcggcagcccacgagggcggcgtcgatttcggtatggaggacatcgaccggctttcccgcaaggttccctgcctttccaaggttgcgcctgcgaagcaggatgtgcacatggaagacgtgcatcgcgccggcggcatcatgcgtattctcggtgagctggagcgtggcggtctcatcaaccgcgatacctataccgtacacgaagcgacgcttggcgatgccatcgaccgctgggacatcacgcgcaccaacagcgaaatggtgcggcagttcttcaaggccgctccgggcggcgtaccgacacaggtggccttcagccagtcctcgcgctgggatgatctggacaccgacagcgacaacggcgtcattcgttcggtcgagaagcctttctccaaggatggcggtctggccgttctttacggcaacatcgcgctcgatggctgcatcgtgaagacggcgggtgttgatgaatccatcctgaaattcaacggatcggcagtcgtttacgaaagccaggacgcggccgtgaagggcattctcggcaacgaggtcaaggcgggcgacgtcgtcgtcatccgctatgaaggaccgaagggcggcccgggcatgcaggaaatgctctatccgaccagctacctcaagtccaagggcctcggtaaagcctgcgcgctcatcaccgatggtcgcttctccggtggcacgtcaggcctttccatcggtcatgcctcgccggaagcggcgcagggcggtgccatcggcctcgtgcgtcagggcgacctgattgagatcgatattccgaaccgcacgatcaatctcaaggtttcggatgcggaactggccgcgcgccgggccgagcaggaagaaaagggctggaagccggaagcaccgcgcaagcgtaatgtcacgacggcgctcaaggcctatgcggcctttgcgtcgagcgcggacaagggtgctgtgcggattctgccggagtaa

SEQ ID NO: 662 - protein, 611 aa, Agrobacterium tumefaciens
MPAYRSRTTTHGRNMAGARGLWRATGMKDSDFGKPIIAVVNSFTQFVPGHVHLKDLGQLVAREIEAAGGVAKEFNTIAVDDGIAMGHDGMLYSLPSREIIADSVEYMVNAHCADAMVCISNCDKITPGMLNAAMRLNIPAVFVSGGPMEAGKVVLHGKTVALDLVDAMVAAADDKISDEDVKIIERSACPTCGSCSGMFTANSMNCLTEALGLSLPGNGSTLATHSDRKRLFVEAGHLIVDLARRYYEQDDETVLPRTIANKAAFENAMSLDIAMGGSTNTVLHILAAAHEGGVDFGMEDIDRLSRKVPCLSKVAPAKQDVHMEDVHRAGGIMRILGELERGGLINRDTYTVHEATLGDAIDRWDITRTNSEMVRQFFKAAPGGVPTQVAFSQSSRWDDLDTDSDNGVIRSVEKPFSKDGGLAVLYGNIALDGCIVKTAGVDESILKFNGSAVVYESQDAAVKGILGNEVKAGDVVVIRYEGPKGGPGMQEMLYPTSYLKSKGLGKACALITDGRFSGGTSGLSIGHASPEAAQGGAIGLVRQGDLIEIDIPNRTINLKVSDAELAARRAEQEEKGWKPEAPRKRNVTTALKAYAAFASSADKGAVRILPE

SEQ ID NO: 663 - DNA, 1902 bp, Burkholderia cenocepacia
gtgcctccacccttttcccgcgatatttcttcagccatcaccatgcccacttaccgttccaaaacctccaccgccggccgcaacatggcaggtgcgcgctcgctgtggcgcgccaccggcatgaaagacgacgatttctcgaaaccgatcatcgcggtcgtcaactcgttcacgcaattcgtgcccgggcacgtgcacctgaaggatctcggccagctcgtcgcgcgcgagatcgaggctgccggcggcgtcgcgaaggaattcaacacgatcgcggtcgacgacggcatcgcgatgggccacgacggcatgctgtactcgctgccgagccgcgacatcatcgccgactcggtcgaatacatggtgaacgcgcactgcgcggacgcgatggtgtgcatctcgaactgcgacaagatcacgccggggatgctgatggccgcgatgcgcctgaacattccggtgatcttcgtgtcgggcggcccgatggaagccggcaagacgcgcctcgcgaacccggtcaccaagaccgtcgaactgaagaagctcgacctcgtcgacgcgatggtgatcgcggccgaccagtcgtattcggacgccgacgtcgccgaagtcgaacgctcggcctgcccgacctgcggctcgtgctcgggcatgttcaccgcgaactcgatgaactgcctgaccgaagcgctcggcctgtcgctgcccggcaacggtacggtggtcgccacgcacgccgatcgcgaacagctgttcaagcgcgccggccgccgcatcgtcgaactgacgcgccagcactacgagcaggacgacgaacgcgtgctgccgcgctcggtcggcttcaaggcgttcgagaacgcgatgacgctcgacatcgcgatgggcggctcgaccaacacgatcctgcacctgctcgcgatcgcgcaggaagccggcatcgacttcacgatgaaggacatcgaccgcctgtcgcgcaccgtgccgcagctgtgcaaggtcgcgccgaacacgaacaagtaccacatcgaggacgtgcaccgcgccggcggcatcatggcgatcctcggcgagctcgagcgcgccggcaagctgcacaccgacgtgccgaccgtccatgcgccgacgctgaaggatgcgctcgaccagtgggacatcgtcctcacgcaggacgaagcggtccgcaggttctacctggccggcccggccggcatcccgacgcaggtcgcgttcagccagaacacgcgctggccgagcctcgacctcgaccgcgccgaaggctgcatccgctcgtacgagcatgcgttctcgaaggaaggcggcctcgcggtgctgacgggcaacatcgcgctcgacggctgcgtggtgaagacggccggcgtcgacgaaagcatcctcgttttcgaaggctcggcgcacgtgaccgaatcgcaggacgaagcggtcgagaacatcctcaacgacaaggtcaaggccggcgacgtggtgatcgtgcgctacgaaggcccgaagggcggcccgggcatgcaggaaatgctctacccgaccagctacatcaagtcgaaagggctcggcaaggcgtgtgcgctgctgacggacggccggttctcgggtggtacgtcggggctgtcgatcggccattgctcgccggaagcggcggcaggcggcgcgatcggcctcgtgcgcgacggcgaccggatccgcatcgacattccgaaccgcacgatcgacgtgctggtgtcggacgaggaactggcgcgccgccgcgaggagcagaacgcgaagggctggaagcctgcgcagccgcgtccgcgcaaggtgtccgcggcgctcaaggcgtacgcgaagctcgtcatgtcggccgacaagggcgccgtgcgcgatctgtcgctgctcgacgactga

SEQ ID NO: 664 - protein, 633 aa, Burkholderia cenocepacia
MPPPFSRDISSAITMPTYRSKTSTAGRNMAGARSLWRATGMKDDDFSKPIIAVVNSFTQFVPGHVHLKDLGQLVAREIEAAGGVAKEFNTIAVDDGIAMGHDGMLYSLPSRDIIADSVEYMVNAHCADAMVCISNCDKITPGMLMAAMRLNIPVIFVSGGPMEAGKTRLANPVTKTVELKKLDLVDAMVIAADQSYSDADVAEVERSACPTCGSCSGMFTANSMNCLTEALGLSLPGNGTVVATHADREQLFKRAGRRIVELTRQHYEQDDERVLPRSVGFKAFENAMTLDIAMGGSTNTILHLLAIAQEAGIDFTMKDIDRLSRTVPQLCKVAPNTNKYHIEDVHRAGGIMAILGELERAGKLHTDVPTVHAPTLKDALDQWDIVLTQDEAVRRFYLAGPAGIPTQVAFSQNTRWPSLDLDRAEGCIRSYEHAFSKEGGLAVLTGNIALDGCVVKTAGVDESILVFEGSAHVTESQDEAVENILNDKVKAGDVVIVRYEGPKGGPGMQEMLYPTSYIKSKGLGKACALLTDGRFSGGTSGLSIGHCSPEAAAGGAIGLVRDGDRIRIDIPNRTIDVLVSDEELARRREEQNAKGWKPAQPRPRKVSAALKAYAKLVMSADKGAVRDLSLLDD

SEQ ID NO: 665 - DNA, 1911 bp, Psychrobacter cryohalolentis
atggattacaattcaaaaacctctaccggcggtcgtaatatggcaggtgctcgtgccctgtggcgcgcaactggcatgactgatggcgactttggcaaacctattattgcaattgccaactcttttacccagtttgtacccggccatgtgcatttaaaagatttgggacaaatggttgcacgcgagattgaaaaagcgggtggcgtggcaaaagaatttaataccattgctgttgatgatggtattgccatgggtcatagcggcatgttgtattcactaccgagtcgagatttgattgctgattctgtcgagtatatggtcaatgcccactgcgccgatgcgctagtatgtatttctaactgcgataaaatcactccgggtatgttgatggcagccatgcgcctcaatatccccgtcgtctttatttcaggtggcccaatggaagcgggtaaaattatcgccagcacggtcgcacacagtcataataatgatggtagtagcgacgtccatagcactgacagtaaaggtaatgccattcgtaagcttgacctcgttgatgcgatgatggacgcggccgatgatagcattagtgatgaagatgtcgctgctattgaggcctcagcgtgcccgacttgtgggtcgtgctctggcatgttcactgccaactcgatgaattgcttgaccgaagcattaggattggcattaccgggtaatggctcgctattggcaacccattcgctacgtcgcgagctattcctagaagcgggtcgtactatcgtgtcactagccaaacgtcgctacgagcaagatgatgattcagtcctaccgcgctctatcgctactaaagccgcgtttgaaaatgccatgactttagacatcgccatgggcggctctaccaatactattttgcatttgcttgctgctgcacatgaagccgaagtcgacttcaaaatgcacgatattgaccgtttaagtcgtggcgtcccttgtttggctaaagttgcccctgcttcacaaaagtatcatatggaagatgtgcatcgtgctggtggtgtctttgcgctattggccgagcttgaccgtgctggtttgctgcataccgatttgccaactatccatagtgccacgatgaaagaagcgattgataaatgggatattatgaatcctgacaatcttgaagcacgtgcacgctatattgcagcccctggtggcgtacggacgactgaggctttctcacaatcaaaagaatggtcaaatctggatgtgaaccgagagtcaggctgtatccgaagtgcccaacatgcttattcaactgatggcggtcttgccgttctatacggaaacattgctgagcgtggctgtgtggtcaaaactgccggcgttgatgacagcatcttggttttcaccggacgtgcacgcatctttgaatcacaagatgatgcagtagcagcggtgcttgatgatcaaatcgtcgcaggcgatgtagttatcatccgttttgagggtccaaaaggcggtcctggtatgcaagagatgctctacccgacgacttatctaaaatctaaaggcctaggcaaagaatgtgcgctgcttacagatggtcgcttctctggtgggacatcaggcttgtctattggtcatgccagcccagaagccgctgaaggcggcgccattggcctagtgcaagaaggcgatactatccatattgatatcccaaaccgtaccatcaatatgcaggtcagtgatgaagagttagctgctcgccgcgaagaaatggaaagtcgtggacgtgatgcttggaaacccgttagccgtgagcgtcatgtctctcctgctttacgtgcctatgctgcaatgaccaccagtgccgatacgggcgctgtacgtgacgtcagccaagttgaacgttag

SEQ ID NO: 666 - protein, 636 aa, Psychrobacter cryohalolentis
MDYNSKTSTGGRNMAGARALWRATGMTDGDFGKPIIAIANSFTQFVPGHVHLKDLGQMVAREIEKAGGVAKEFNTIAVDDGIAMGHSGMLYSLPSRDLIADSVEYMVNAHCADALVCISNCDKITPGMLMAAMRLNIPVVFISGGPMEAGKIIASTVAHSHNNDGSSDVHSTDSKGNAIRKLDLVDAMMDAADDSISDEDVAAIEASACPTCGSCSGMFTANSMNCLTEALGLALPGNGSLLATHSLRRELFLEAGRTIVSLAKRRYEQDDDSVLPRSIATKAAFENAMTLDIAMGGSTNTILHLLAAAHEAEVDFKMHDIDRLSRGVPCLAKVAPASQKYHMEDVHRAGGVFALLAELDRAGLLHTDLPTIHSATMKEAIDKWDIMNPDNLEARARYIAAPGGVRTTEAFSQSKEWSNLDVNRESGCIRSAQHAYSTDGGLAVLYGNIAERGCVVKTAGVDDSILVFTGRARIFESQDDAVAAVLDDQIVAGDVVIIRFEGPKGGPGMQEMLYPTTYLKSKGLGKECALLTDGRFSGGTSGLSIGHASPEAAEGGAIGLVQEGDTIHIDIPNRTINMQVSDEELAARREEMESRGRDAWKPVSRERHVSPALRAYAAMTTSADTGAVRDVSQVER

SEQ ID NO: 667 - DNA, 1851 bp, Psychromonas sp.
atgcccaaattacgttcagcaactagtacagaaggccgaaacatggcaggcgcgcgtgcattgtggcgcgccactggcgtcaaagataatgattttggaaaacctattattgccattgcgaattcatttacccaatttgttcctgggcatgtacatcttaaaaacatgggtgatttagtggcgggtgcgattgctgaggcgggcggtatctctaaagaatttaataccattgcggttgatgacggcattgcgatgggccattcaggtatgctttatagtttaccttcacgtgacctgattgctgatagtgttgaatatatggtaaatgcacattgtgcggatgctttagtgtgtatttcaaattgtgacaagatcacgccggggatgttgatggcggcattacgccttaatattccggttgtttttgtctcaggtggcccgatggaagcgggtaaaaccaagctttcagataaaattattaagttagatttggtcgatgccatggtggcgggcgcagacgacaggatctccgacgctgacagtgcacaaattgagcgcagtgcttgcccaacgtgtggctcttgctctggtatgtttaccgctaactccatgaactgtctaacggaagtcttagggttatcactacccggtaatggcactatgcttgcaacgcacgcagacagacgcgctcttttcttagaagcgggaaagtgcattgtggcattaacgaaacgttattatgacgatgacgatgagtctgttttaccgcgtaatattgccaattttaaagcctttgaaaacgccatgacacttgatattgcgatgggaggctcaagtaatacggtgctgcatttattagctgctgcccaagaagcgcatattgattttaacatggatgatattgatagaatttcacgcttagtgcctcatttgtgcaaagttgccccctctacacctaaatatcatatggaagatgtgcaccgcgcaggtggggtaatgggtattttaggcgaattggacagagccggccttattcataatgacgctaatcatgtggcgggcagtagtttaaaagcggtattagagaaatgggatattgtgcaaactaaagaggcgagtgtgcgtgatttttaccgcgcaggtccgggaggtattccaactcagcaagcttttagtcaggatagtcgctgggatagtgtggatgatgacaggcagaatggctgtattcgtaaacgtgaatttgcgtttagccaagaaggcggacttgccgtgctggcgggtaatattgcgccaaagggctgtattgttaaaacggcgggggtcgatgaagaagagcatcaatttaccggtacggcgcgcgtgtttgagagccaagatgatgcagtgagcgccatcttagcgggaaaagtgattgcgggtgatgtggttgtcattcgttatgaaggccccaaaggtggccccggcatgcaagaaatgttgtatcccaccagttatttaaaatcacgtgggttaggtaaatcatgtgccttaataaccgacggacgattttcgggtggaacctcgggcttatcgattgggcatatttctccagaggctgcagcgggcggtaatattgccttgattgagacgggtgatgttatcaaaattgatattcctgcacgcagtattcaccttgatattagtgatgaagagctcaagttacgccataaaaatatgctagcgcgcggtaaacttgcttggaaacccgtttcgagaaaacgtattgtgccactcgcgcttaaagcttacgctttgctggtgaccagtgcagataaaggggcggttcgtgacgcttcaatgttggaggattaa

SEQ ID NO: 668 - protein, 616 aa, Psychromonas sp.
MPKLRSATSTEGRNMAGARALWRATGVKDNDFGKPIIAIANSFTQFVPGHVHLKNMGDLVAGAIAEAGGISKEFNTIAVDDGIAMGHSGMLYSLPSRDLIADSVEYMVNAHCADALVCISNCDKITPGMLMAALRLNIPVVFVSGGPMEAGKTKLSDKIIKLDLVDAMVAGADDRISDADSAQIERSACPTCGSCSGMFTANSMNCLTEVLGLSLPGNGTMLATHADRRALFLEAGKCIVALTKRYYDDDDESVLPRNIANFKAFENAMTLDIAMGGSSNTVLHLLAAAQEAHIDFNMDDIDRISRLVPHLCKVAPSTPKYHMEDVHRAGGVMGILGELDRAGLIHNDANHVAGSSLKAVLEKWDIVQTKEASVRDFYRAGPGGIPTQQAFSQDSRWDSVDDDRQNGCIRKREFAFSQEGGLAVLAGNIAPKGCIVKTAGVDEEEHQFTGTARVFESQDDAVSAILAGKVIAGDVVVIRYEGPKGGPGMQEMLYPTSYLKSRGLGKSCALITDGRFSGGTSGLSIGHISPEAAAGGNIALIETGDVIKIDIPARSIHLDISDEELKLRHKNMLARGKLAWKPVSRKRIVPLALKAYALLVTSADKGAVRDASMLED

SEQ ID NO: 669 - DNA, 1824 bp, Deinococcus radiodurans
atgccgacttaccgttccagaaccaccaccgagggccgtaatatggccggcgcccgtgccctgtggcgcgccaccggcatgaccgacggcgatttccagaagccgatcatcgcggtggtcaactcgttcacccagttcgtgccggggcacgtgcacctcaaggacctcgggcaactcgtcgcgggtgaaatcgcggcggcgggcggcgtggcgaaggagttcaacaccatcgccgtggacgacggcatcgccatgggccacgacgggatgctctactcactgcccagccgcgaaatcatcgccgacagcgtggagtacatggtcaacgcccactgcgccgacgcgatggtttgcatctccaactgcgacaagattacccccggcatgctgatggccgcgctgcgcctcaatatccccaccgtgttcgtctcgggcgggccgatggaagcgggcaaggtcaagctcggtgacggcgagcacgcgctggacctggtggacgcaatggtgatggccgccgacgacagcgtgagcgaggaagacatcgaactggtggagcgctcggcctgccccacctgcggctcgtgctcgggcatgttcaccgccaactcgatgaactgcctgacggaggcgctgggcctctcgctgccgggcaacggctcggtgctggcgacccactccgaccgccagaacctgttcaagcgcgccgggcacctgatcgtggacctcgccaagcgctactacgagggcgatgacgagagcgtgctgccgcgcagtgtcgccacctacgacgccttcgagaacgccatgaccctcgacatctcgatgggcggctcgaccaatacggtgctgcacctgctggccgccgcgcacgaggccggggtggatttcaccatgcaggacatcgaccagctctcgcggcgggtgccggtgctgtgcaaggtggcgcccgccaagaacgacgtgcacatggaagacgtgcaccgcgctgggggcatcatgggcattctgggcgagcttgaccgcgccgggctgctgaagaccgacgtgagcaccgtacacgcccccagcatgagcgccgccctgaacgagtgggacgtggtccgcaatgagaaccaccacgagttctaccgcgccgcgcccggcggcattcccaccgtcttcgccttctcgcagtcgcgccgttaccgcgaactcgacaccgaccgggaagcaggcgtcattcgcagcgccgagcacgctttctcgcaggacggcgggctggcggtgctgtacggcaacctcgccgaagacggctgcatcgtcaagacggcgggcgtggacgaatccatcctgaagttcagcggcccggcgcgcgttttcgagtcgcaagacgcctcggtggacgccatcctcagcggcgaagtcaaggaaggcgaggtcgtgctgattcgctacgaaggcccacgcggtggccccggcatgcaggaaatgctctacccgacgagctacctcaagtccaaggggctgggcaaagcctgcgcgctggtcaccgacggtcgtttctcgggcggcagcagcggcctgagcatcggccacgtctcgcccgaggcggcggagggcggcaccatcggcctggtcgagacgggcgacctcatcgaaatcgacatcccgaaccgcaccattcacctcgccgtgccggacgctgaactcgccgcccgccgccagaagcgcgaggaagaaggctggcaccccgccgaaccccggccccgcaaaatcaccgctgccctacgcgcctatgcgtctatgacgacgagcgcttcgcggggcgcggtgcggaatatctga

SEQ ID NO: 670 - protein, 607 aa, Deinococcus radiodurans
MPTYRSRTTTEGRNMAGARALWRATGMTDGDFQKPIIAVVNSFTQFVPGHVHLKDLGQLVAGEIAAAGGVAKEFNTIAVDDGIAMGHDGMLYSLPSREIIADSVEYMVNAHCADAMVCISNCDKITPGMLMAALRLNIPTVFVSGGPMEAGKVKLGDGEHALDLVDAMVMAADDSVSEEDIELVERSACPTCGSCSGMFTANSMNCLTEALGLSLPGNGSVLATHSDRQNLFKRAGHLIVDLAKRYYEGDDESVLPRSVATYDAFENAMTLDISMGGSTNTVLHLLAAAHEAGVDFTMQDIDQLSRRVPVLCKVAPAKNDVHMEDVHRAGGIMGILGELDRAGLLKTDVSTVHAPSMSAALNEWDVVRNENHHEFYRAAPGGIPTVFAFSQSRRYRELDTDREAGVIRSAEHAFSQDGGLAVLYGNLAEDGCIVKTAGVDESILKFSGPARVFESQDASVDAILSGEVKEGEVVLIRYEGPRGGPGMQEMLYPTSYLKSKGLGKACALVTDGRFSGGSSGLSIGHVSPEAAEGGTIGLVETGDLIEIDIPNRTIHLAVPDAELAARRQKREEEGWHPAEPRPRKITAALRAYASMTTSASRGAVRNI

SEQ ID NO: 671 - DNA, 1680 bp, Wolinella succinogenes
atgagaagtagcatcattaaagaggggtatcaaaaggcgccacaccgaagcttgctgagggcaacggggctcaaagacgaggattttggtaagccattcattggcgtggccaacagctatattgacatcattccgggtcactttttcttgcaagagtatggccgaatcattaaagaggagattagggccgcgggcggaatcccttttgagtttaacactatcggggtggatgatggaatcgccatggggcatgatggaatgctctatagtttgcccagtcgagagctgattgctgattgtattgagacggtgatgaatgcccataaactggacgccatgatctgtatccctaattgcgacaagattgtccctgggatgcttctgggggcactcagagtgaatgtgcccacggtgtttgtgagtggcggaccgatgaaggcaggtcgcctcaaggatggcaccaaagtggatttggcgagtgcttttgaggcggtgggtaaacgcgcgaggaatcagattagcgatgaagagctccgcgagattgagtgcgccgcctgtccggggggaggaagctgcagtggaatgttcacggcgaactccatgaacacactctgtgaagcgatgggagtggcgcttcccgggaatgggacgattccagccctcaccaaagagcgtgaggagctcatccgaaaagccgcaagaagaatcgtagaaatcgcactagatgagcgctacgccttccgcaatattctcaacaaagaggcgattcacaatgcttttgttgtggatatggcgatggggggaagcaccaataccgtacttcatatgatggccattgccaaagagagagaggcggattttgatttgcgcaaaatcaatgagatcgccaaagaggtgagtcatatcgccaaaatctcccctgcactctacactgtccacatggaagacatcaatagagccgggggcgtgaatgcggtcatgaatgagatcaatcgccgaggcggagtgctcaagacagaggcgctcaccgtgagtggcgagagcatgggtgagaggatcgcgggggcgaagattttagatacgcaaatcattcacacgcttgagaatccctatagcgcggtggggggattgaagattctttatggaaatcttgccgagcagggcgctgtgctcaagaccgctgccatggacgctaagatgagaaaattcactggaaaggcagtctgctttgattctcaagaggaggcgatcgcaggtattgtcgggggcaaggtcaaagagggggatgtggtggtgatccgctacgaaggacccaaggggggaccgggaatgcaggagatgctaagtcccacaagcctcatcatggggatgaatttaggagacaaagtcgcgctcattaccgatggccgtttcagcggcgccacgcgtggcgcttgcatcgggcatgtgagtcccgaagcggccgaagggggaatgatcggactgcttcaagagggcgatcttattcgaatcgatgtcgaagaaggggttttggaggtgttgcttgaggaggcggagatccaaaagcgacgcgcctcctttagtcctaaaactaaaaccgttgcctccaagtggctcaaacgctaccagcttctcgtgagcaatgccgcttcaggcgctattttgaaaacggagctataa

SEQ ID NO: 672 - protein, 559 aa, Wolinella succinogenes
MRSSIIKEGYQKAPHRSLLRATGLKDEDFGKPFIGVANSYIDIIPGHFFLQEYGRIIKEEIRAAGGIPFEFNTIGVDDGIAMGHDGMLYSLPSRELIADCIETVMNAHKLDAMICIPNCDKIVPGMLLGALRVNVPTVFVSGGPMKAGRLKDGTKVDLASAFEAVGKRARNQISDEELREIECAACPGGGSCSGMFTANSMNTLCEAMGVALPGNGTIPALTKEREELIRKAARRIVEIALDERYAFRNILNKEAIHNAFVVDMAMGGSTNTVLHMMAIAKEREADFDLRKINEIAKEVSHIAKISPALYTVHMEDINRAGGVNAVMNEINRRGGVLKTEALTVSGESMGERIAGAKILDTQIIHTLENPYSAVGGLKILYGNLAEQGAVLKTAAMDAKMRKFTGKAVCFDSQEEAIAGIVGGKVKEGDVVVIRYEGPKGGPGMQEMLSPTSLIMGMNLGDKVALITDGRFSGATRGACIGHVSPEAAEGGMIGLLQEGDLIRIDVEEGVLEVLLEEAEIQKRRASFSPKTKTVASKWLKRYQLLVSNAASGAILKTEL

SEQ ID NO: 673 - DNA, 1857 bp, Zymomonas mobilis
atgcctccctatcgttccagaaccacgactcatggtcgtaatatggcgggtgccagaagtttatggcgcgcaaccggcgtcaaaaatgaagattttggtaagccgattatcgctgttgccaacagctttacgcaatttgtccccggtcatgtccatttaaaggatatgggacagcttgttgctgaagaaattgaaaaagctggcggtatcgccaaagaattcaatacgattgcgattgatgatggtatcgcgatgggacatggcgggatgctttattccttgccgtctcgggaattgattgccgattccgtcgaatatatggtcaacgcccattgtgctgatgctttggtctgtatttccaactgcgacaagattacgcctggtatgttgatggcttcgatgcgcctgaatatcccgacagttttcgtctctggtggacctatggaagccggtaaagccgaggtcaaaggcgtcaagcgggcgcttgatctgatcgatgctatggtgattgctgccgatgaccattacagcgatggtgaagtcgaagttatcgagcagacggcttgcgctacctgcggttcctgttccggtatgtttacggccaattcgatgaattgcctgaccgaggccttggggctttctttcccaggtaatggttcgatgcttgcgacccatagcgatcgggaacagcttttccgcaaggctgggcataccattgttgatatggcgcgcagctattatgagcaggatgatgccgctgtattaccgcgttcaattgccacgcttgaggcttttgaaaatgcgatgagtcttgatatcgccatgggtggttccaccaatacggttttgcatctgttggcggtcgcgcaggaaggcaacgtgcctttcactatggcggatattgatcgtctttcccgtcatgtcccttgcttatgcaaggtcgcaccggccaaaaatgatgtccatatggaagatgttcatcgggcagggggcgttatggccattttaggccagcttgatcgtgccggattgatcaataccagcttgcgcaccattcattctccgactttaggcgcagcattggacgcatgggatatcagccgtgacagttgttctgaagaagcgcagttattctatcgcgcggctccggggggtgttccgactcaaaaggctttcagccagtcttctcgctatgaagcgctggatactgaccgcgaaaaaggtgtgattcgttctaaaaatcatgctttttcgacggatggtggtctggccgtcttatttggcaatcttgctcctgaaggcagtattgtcaaaactgccggtgtggatgagtctattctgaaattcaccggtaaagccaaggtttacgaaagtcaggaagccgccgttgccggtattcttggcaatgatgtcgaagctggtgaagtggtgatcgttcgctatgaaggtcccaaaggtggccccggtatgcaggaaatgctgtatccgaccagctatctgaaatcgaaaggtttgggtaaactctgcgctctgattaccgatggtcgtttttctggtggtagctctggtttatccatcggccatgtttctcctgaagcggccgagggcggcttgatcgctttggtcgaaaccggtgatacaattgttatcgatattcctgaacggattatccatctggatgttgatgatgctgttattgccgatcgtcatgcccgcatggaagccaagggggcggcagcatggaaaccgcaaaaccgtaatcgtccgatttcttcggctttgaaagcctatgcagctttgacgacaaacgctgcccgtggggcagttcgagatgtcaatcagctcgaacggcgttaa

SEQ ID NO: 674 - protein, 618 aa, Zymomonas mobilis
MPPYRSRTTTHGRNMAGARSLWRATGVKNEDFGKPIIAVANSFTQFVPGHVHLKDMGQLVAEEIEKAGGIAKEFNTIAIDDGIAMGHGGMLYSLPSRELIADSVEYMVNAHCADALVCISNCDKITPGMLMASMRLNIPTVFVSGGPMEAGKAEVKGVKRALDLIDAMVIAADDHYSDGEVEVIEQTACATCGSCSGMFTANSMNCLTEALGLSFPGNGSMLATHSDREQLFRKAGHTIVDMARSYYEQDDAAVLPRSIATLEAFENAMSLDIAMGGSTNTVLHLLAVAQEGNVPFTMADIDRLSRHVPCLCKVAPAKNDVHMEDVHRAGGVMAILGQLDRAGLINTSLRTIHSPTLGAALDAWDISRDSCSEEAQLFYRAAPGGVPTQKAFSQSSRYEALDTDREKGVIRSKNHAFSTDGGLAVLFGNLAPEGSIVKTAGVDESILKFTGKAKVYESQEAAVAGILGNDVEAGEVVIVRYEGPKGGPGMQEMLYPTSYLKSKGLGKLCALITDGRFSGGSSGLSIGHVSPEAAEGGLIALVETGDTIVIDIPERIIHLDVDDAVIADRHARMEAKGAAAWKPQNRNRPISSALKAYAALTTNAARGAVRDVNQLERR

SEQ ID NO: 675 - DNA, 1659 bp, Clostridium acetobutylicum
gtgaattctgataaggcaatgaaaggagtagaaagagctccccacagatctctttttaaggctttaggttttatagatgaggaaatggatagacctcttataggaatagctaattcttacagcgaacttataccaggtcatatgaatcttgataaaatagttaaggctgtaaaagatggaataagaatggcaggaggtgttcctgtagaatttggaaccattggagtttgtgatggtatttctatgaatcataagggaatgagttattctcttccatcaagacagattatagcagatagtgttgagatcgtggctaaagcacatgctcttgatgggcttgtacttgtgccaaattgcgataaggtagttccaggaatgcttatggcggctggaagagttaacataccttcaatagtaataagtggaggaccaatgctttctggtagaacaaatggaagggtcacagatctaaactctgtattcgaagcagttggagcagtttcagcgggaaaaatgtctttagaagaattagctgagcttgagaatacggcatgccctacttgtgggtcttgttctggaatgtttacagcaaattcaatgaactgtctttctgaggttttaggtcttgcgcttccttacaatggaactataccagctgtattttcagaaagattaagacttgctaaaaaggcaggtatgaaaatagttgaattggttcaaaaggacataagaccaagtgacatacttacagaagctgcatttatgaatgcagtcgcaatggatatggcactagggggttctactaattcacttcttcatttaccagctatagcttatgaatgtgacgtggatattaatttcgataaaataaatgagataagtgaaaagattccgcatgtgtgtaagttaagtcctgcaggatttcatcacatagaggacttgcatatggcaggtggaataccggctgttgttaatggaattataaaaaaaggacttctaaatggagagtgtatgacagttacaggtaaaactttgtatgagaatgtgaaggatgcgaaaatcaaaaacattgatgtaataagaatagataatccttatagtgagacaggtggactttcagtattgagaggaaatttagctccagatggcgctatagttaaaaaggcagcagtagcacccgaaatgatgcagcatactggtccggctagggtatttaatagtgaagaggaagtttctaaggcaatacttggtggaaaaataaatccaggtgatgttgttgtgataaggtatgagggccctaagggtggaccaggaatgaaggaaatgctttcgccaacagcttcacttgcaggaatgggacttgataagagtgtggcgcttataactgatggaagattctcaggtgctacaagaggagcatccattggacatgtatctccagaagcggcagaaggtggtccaatagggttggttgaagagggagacacaattgaaatagatattgaaaagaaaactataaacctacttgttccggaagaaaaattaaaaaacagaaaaccggaaaaggttgaaaaacctgtgaagggatatttaaatacgtataggcagggggtatcatctgcttgtacaggagcagtttttcatagtacaaaggagtga

SEQ ID NO: 676 - protein, 552 aa, Clostridium acetobutylicum
MNSDKAMKGVERAPHRSLFKALGFIDEEMDRPLIGIANSYSELIPGHMNLDKIVKAVKDGIRMAGGVPVEFGTIGVCDGISMNHKGMSYSLPSRQIIADSVEIVAKAHALDGLVLVPNCDKVVPGMLMAAGRVNIPSIVISGGPMLSGRTNGRVTDLNSVFEAVGAVSAGKMSLEELAELENTACPTCGSCSGMFTANSMNCLSEVLGLALPYNGTIPAVFSERLRLAKKAGMKIVELVQKDIRPSDILTEAAFMNAVAMDMALGGSTNSLLHLPAIAYECDVDINFDKINEISEKIPHVCKLSPAGFHHIEDLHMAGGIPAVVNGIIKKGLLNGECMTVTGKTLYENVKDAKIKNIDVIRIDNPYSETGGLSVLRGNLAPDGAIVKKAAVAPEMMQHTGPARVFNSEEEVSKAILGGKINPGDVVVIRYEGPKGGPGMKEMLSPTASLAGMGLDKSVALITDGRFSGATRGASIGHVSPEAAEGGPIGLVEEGDTIEIDIEKKTINLLVPEEKLKNRKPEKVEKPVKGYLNTYRQGVSSACTGAVFHSTKE

SEQ ID NO: 677 - DNA, 1671 bp, Clostridium beijerinckii
atgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaa

SEQ ID NO: 678 - protein, 556 aa, Clostridium beijerinckii
MRSDVITKGSKSAPQRSLLSALGLTKEEMERPLVGIVSSQNDIVPGHMNLDKIVEAVKMGVSMAGGTPIVFPAIAVCDGIAMGHEGMKYSLVTRDLIADSTEAMAMAHAFDALVMVPNCDKNVPGLLMAAARVNIPTIFVSGGPMLAGKVDGCKTSLSSMFEAVGAYNAGKITAEKLDEYENNVCPTCGSCSGMYTANSMNCLTEVLGMGLQGNGTIPAVYSERIKLAKHAGMKIMELLEKNIRPRDIMTEDAFMNAMTMDMALGCSTNSMLHLPAIAHEVGFDLNVDIANEISSKTPNLCHLAPAGHTYIEDLNDAGGIYAVMNEINKLGLLKTNLITCTGKTVGENIEGCINKNPEVIRPVKNPYSQTGGIAVLKGNLAPDSCVVKRSAVVPKMLKHEGPAKVFDCEEDALEAINTGKIVAGDVVVIRYEGPKGGPGMREMLNPTSAIAGRGLGSSVALITDGRFSGASRGASIGHVSPEAAVGGNIALVEDGDMIQIDINANTINFLVSDEELARRKANWKPRKPKITTGYLARYAALVTSGNRGAILDIPKF

SEQ ID NO: 679 - DNA, 1842 bp, Pseudomonas fluorescens
atgcctgattaccgctcgaaaacatccacccatggccgcaacatggccggcgcccgcgccctgtggcgcgccacggggatgaaagatgacgacttcaagaagccgatcatcgccattgccaactccttcacccagttcgtcccggggcacgtgcacctgaaggacctgggccagctggtggctcgcgagatcgaacgcgccggtggcgtggccaaggaattcaacaccatcgccgtggacgacggcatcgccatgggccatgacggcatgctgtattcgctgccgagccgcgagatcatcgccgactccgtggagtacatggtcaacgcccactgtgccgacgccatcgtgtgcatttccaactgcgacaagatcacccccggcatgctgatggccgccctgcgcctgaacatcccggtgatcttcgtttccggcggcccgatggaagccggcaagaccaagctcgccagccatggcctggacctggtggacgccatggtcatcgccgccgactccagcgcttctgacgagaaggttgccgagtacgagcgcagcgcctgcccgacctgcggttcatgctccggcatgttcaccgccaactccatgaactgcctgaccgaagccctggggctcgccctgccgggcaacggttcgaccctggccacccacagcgatcgcgaagagctgttcctgcgggccgggcgcaccatcgtcgagctgtgccagcgctactacggcgacaacgacgagtcggtcctgccgcgcaacatcgccaacttcaaggcgttcgagaacgccatgaccctggatatcgccatgggcggttccaccaacaccatcctgcacctgctggccgccgcccaggaagccgagatcgacttcgacctgcgggacatcgatcgcctgtcgcgccacgtgccgcagctgtgcaaagtggcgccgaacatccagaagtaccacatggaagacgtgcaccgcgccggcggtatcttcagcatcctcggcgaactggcccgtggcggcctgctgcacaccgacctgcccaccgtgcacagcaagaccatggccgaaggcatcgcccagtgggacatcacccagaccagcgacgaagccgtgcatcacttcttcaaggccggcccggcgggcatcccgacccagacggcgttcagccagtcgacccgttgggacagcctcgacgatgaccgtgaaaacggctgcatccgcagtgtcgagcatgcctactcgaaagaaggcggcctggccgtgctctacggcaacatcgccctggacggctgcgtggtgaagaccgccggtgtcgacgagtcgatccatgtcttcgaaggcaacgccaagatcttcgagagccaggacagcgcggtgcgcggcatcctcgccgacgaggtgaaggaaggcgacatcgtgatcatccgttacgaaggcccgaaaggcggcccgggcatgcaggaaatgctctatccgacctcctacctgaagtccaagggcctgggcaaagcctgcgccctgctcaccgacggccgcttctccggcggcacctcgggcctgtccatcggccacgcctcgcctgaagcggcagccggtggcaccatcggcctggtgcaggacggcgacaaggtactgatcgacattcccaaccgctcgatcaacctgttggtcagcgacgaggaactggcggcccgccgtgtcgagcaggacaagaaaggctggaaaccggtggaagcacgcccgcgcaaggtgaccaccgcgctgaaggcctacgccctgctagccaccagcgccgacaagggtgcggtgcgcaacaaggccatgctcgacggcctgtga

SEQ ID NO: 680 - protein, 613 aa, Pseudomonas fluorescens
MPDYRSKTSTHGRNMAGARALWRATGMKDDDFKKPIIAIANSFTQFVPGHVHLKDLGQLVAREIERAGGVAKEFNTIAVDDGIAMGHDGMLYSLPSREIIADSVEYMVNAHCADAIVCISNCDKITPGMLMAALRLNIPVIFVSGGPMEAGKTKLASHGLDLVDAMVIAADSSASDEKVAEYERSACPTCGSCSGMFTANSMNCLTEALGLALPGNGSTLATHSDREELFLRAGRTIVELCQRYYGDNDESVLPRNIANFKAFENAMTLDIAMGGSTNTILHLLAAAQEAEIDFDLRDIDRLSRHVPQLCKVAPNIQKYHMEDVHRAGGIFSILGELARGGLLHTDLPTVHSKTMAEGIAQWDITQTSDEAVHHFFKAGPAGIPTQTAFSQSTRWDSLDDDRENGCIRSVEHAYSKEGGLAVLYGNIALDGCVVKTAGVDESIHVFEGNAKIFESQDSAVRGILADEVKEGDIVIIRYEGPKGGPGMQEMLYPTSYLKSKGLGKACALLTDGRFSGGTSGLSIGHASPEAAAGGTIGLVQDGDKVLIDIPNRSINLLVSDEELAARRVEQDKKGWKPVEARPRKVTTALKAYALLATSADKGAVRNKAMLDGL

SEQ ID NO: 681 - DNA, 1653 bp, Methanococcus maripaludis
atgataagtgataacgtcaaaaaaggagttataagatctccaaaccgagctcttttaaaagcttgcggatattcagacgaagacatggaaaaaccatttattggtgttgtaaacagcttcacagaagttgttcctggccacattcacttaaaaacattatcagaagcagttaaacatggtgtttatgcaaacggcggaacgccatttgaatttaatacaattggaatttgcgacggtattgcaatgggtcatgaaggtatgaaatactccttaccttcaagagaaatcattgcagatgctgttgaatcaatggcaagagcacacggttttgatggccttgttttaattcctacgtgtgataaaatcgttcctggaatgataatgggtgctttaagattaaatattccatttatcgtagttactgggggaccaatgcttccaggcgaattccaaggtaaaaaatgcgaacttattagtctttttgaaggggttggtgagtatcaggttggaaaaattactgaagaagaattaaaaagtattgaagaatgtgcgtgcccgggtgctggaagctgtgcagggctttacactgcaaacagtatggcatgccttacagaagctctcggactatctcttccaatgtgtgcaacaatacatgcggttgatgctcaaaaggttagaatcgctaaaaaaactggctctaaaattgttgacttggtaaaagaagatgtaaaaccaacagatatattgacaaaggaagcttttgaaaacgctattttagttgaccttgcacttggtggatcgacaaatacaacattacacattcctgcaattgcaaatgaaattgaaaataaattcataactctcgatgactttgatagattgagcaacgaagttccacacattgcatcaatcaaacccggtggagaacactacatgattgacctccataatgcaggaggtattcctgcagtattaaatgttttaaagggaaaaattagagatacaaaaacggttgacggaagaagtactttagaaattgcagaatctgtcaaatacataaattacgacgttataagaaaagtagaagctccagttcacgaaactgccggtttgagagttttaaaaggaaatcttgctccaaacggttgcgttgtaaaaatcggtgcagtaaatccaaaaatgtacaaacacgatggacctgcaaaagtttacaattcagaagatgaagcaatttctgcgatactcggtggaaaaattgtagaaggcgacgttatagtaattagatacgaaggaccatcaggtggcccgggaatgagagaaatgctctccccaacttcagcaatctgtggaatgggtcttgatgacagcgttgcattaattactgacggaagattcagtgggggaagcagaggtccatgtataggccacgtttctccagaagctgctgctggcggagtaattgctgcaattgaaaacggagatatcatcaaaattgacatgattggaaaagaaataaatgttgatttggatgaatcagtaattaaagaaagactttcaaaattggatgaatttgagcctaaaatcaaaaaaggctatttatcaagatattcaaggctcgtttcttcagctgatgaaggagcggttttaaaataa

SEQ ID NO: 682 - protein, 550 aa, Methanococcus maripaludis
MISDNVKKGVIRSPNRALLKACGYSDEDMEKPFIGVVNSFTEVVPGHIHLKTLSEAVKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKCELISLFEGVGEYQVGKITEEELKSIEECACPGAGSCAGLYTANSMACLTEALGLSLPMCATIHAVDAQKVRIAKKTGSKIVDLVKEDVKPTDILTKEAFENAILVDLALGGSTNTTLHIPAIANEIENKFITLDDFDRLSNEVPHIASIKPGGEHYMIDLHNAGGIPAVLNVLKGKIRDTKTVDGRSTLEIAESVKYINYDVIRKVEAPVHETAGLRVLKGNLAPNGCVVKIGAVNPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIGKEINVDLDESVIKERLSKLDEFEPKIKKGYLSRYSRLVSSADEGAVLK

SEQ ID NO: 683 - DNA, 1653 bp, Methanococcus aeolicus
atgataagtgataacttaaagaagggagtttccagagctccaaacagaagtttattaaaggcatgcggatatacggacgaagaaatagaaaaaccattcataggtatagtaaatagctttacagaagtagttcccgggcatattcatttaaatacattggcagaagctgcaaaaaagggagtttatgcaaacggcggaacaccttttgaatttaacactatggccgtatgtgatggtatagctatgggacatgagggaatgagatattcattaccatcaagagagataatagctgatacagtagaaagtatggcgaaagctcatggatttgatggattggtgcttattccgtcctgtgataaaattgttcctggtatgattatgggggctctaagattaaatattccattcatagtaataactggcggacctatgcaacctggggagctccacggtaaaaagtatgaccttataagtgtgtttgaaggagttggagaatataatgttggaaaaattacaaaagaggaattaatggaaattgaaacctgtgcctgtccgggagctggtagctgtgctggattatttacggcaaatagtatggcctgtttaaccgaaacacttggtttatcccttcctatgtgtgctactacacatgcaacagatgccgaaaaggtgagaattgcaaaaagaagcggtatgaaaatagttgatttggtaaaagaagatataaaaccaacagatttattaacaaaggaatcatttgaaaatgcaatattggttgatttggctttgggaggttcttcaaatacaacacttcatattccagctttggcttatgaaatagcaccagagtttataactcttgacgattttgataggttatgcgacgaggtgccacatattgcttcattaaggccggggggagaccactttataagcgatttgcatagggcaggaggtattccagctgttttaaaaatattggagcaaaaaataagggatgctaacactgtaagcggtaaatctattaaagagataataaatgaggtaaaatacattgattataatataattagaccagtggataaaccagtgcatgagaccgcaggattaaggatattaaaaggaaatatagcacctgatggctgtgttgtaaaaattagtgctgtaaatccaaagatgtataaacacgaggggcctgcacgggtatttaattcagaggaggaaaccattgacgcaatacttgggggggacattaaagaaggagatgttgttgtaataagatatgaaggtccagcaggaggtccgggaatgagagaaatgttgtctccaacttctgctatttgtggtatgggattagatgactctgttgcacttattacagatggtagatttagtgggggaagtagaggtccatgtattggacatatctcaccagaggcaatggcaggaggtccaatagccataattgaagaaggagatataattgctattgatatgatggcaaaagaaataaacttaaaaataagcgaagaagagataaaagaaagattagctaattggaaaaaaccagaaataaaagttaaaaaaggatatatatcaagatatgctaaattagtatcttcggcaaatgaaggggcagtattgaaataa

SEQ ID NO: 684 - protein, 550 aa, Methanococcus aeolicus
MISDNLKKGVSRAPNRSLLKACGYTDEEIEKPFIGIVNSFTEVVPGHIHLNTLAEAAKKGVYANGGTPFEFNTMAVCDGIAMGHEGMRYSLPSREIIADTVESMAKAHGFDGLVLIPSCDKIVPGMIMGALRLNIPFIVITGGPMQPGELHGKKYDLISVFEGVGEYNVGKITKEELMEIETCACPGAGSCAGLFTANSMACLTETLGLSLPMCATTHATDAEKVRIAKRSGMKIVDLVKEDIKPTDLLTKESFENAILVDLALGGSSNTTLHIPALAYEIAPEFITLDDFDRLCDEVPHIASLRPGGDHFISDLHRAGGIPAVLKILEQKIRDANTVSGKSIKEIINEVKYIDYNIIRPVDKPVHETAGLRILKGNIAPDGCVVKISAVNPKMYKHEGPARVFNSEEETIDAILGGDIKEGDVVVIRYEGPAGGPGMREMLSPTSAICGMGLDDSVALITDGRFSGGSRGPCIGHISPEAMAGGPIAIIEEGDIIAIDMMAKEINLKISEEEIKERLANWKKPEIKVKKGYISRYAKLVSSANEGAVLK

SEQ ID NO: 685 - DNA, 1842 bp, Vibrio fisheri
atgccaacttatcgttcagccaccaccactcacggacgtaacatggccggagcacgcgctttatggcgtgcaactggcgttaaagaagatgactttggtaaacccatcattgctgttgttaactcatttactcaatttgttccgggtcacgtacatcttaaagacatgggacaacttgttgctggcgaaatagaaaaagccggcggtatcgccaaagagtttaatactatcgccgttgatgatggtatcgctatgggtcacggtggcatgctttattctctgccatcacgcgaactcattgcagactctgttgaatacatggttaatgctcactgtgctgatgctatggtatgtatttctaactgcgacaaaattaccccaggaatgatgatggctgcaatgcgtcttaacattccagtaatttttgtgtcaggcggcccaatggaagcaggaaaaactaagctttcagatcaaataatcaaactggatcttgttgatgcaatgatccaaggtgccgatcctacggtttccgatgctcaaagtgagcagatcgagcgttcagcttgtccaacttgtggatcgtgttcaggaatgttcacggctaactcaatgaactgtttaaccgaagcgctcggtttatctcaaccaggtaatggctcaatgctcgctactcacgccgaccgcgagcagctgtttattaatgcaggtaaacgtattgttgaattaacaaagcgttattatgagcaagatgatgaatcagcacttccaagaaatattgccgaccgtgctgcatttgaaaatgccatggcacttgatatcgcaatgggtggttctagtaataccgttcttcaccttttagcttctgctcaagaaggcgaaattgatttcgatatgggtgacattgatgagatgtctcgtcgagtacctcacttgtgtaaagtcgctccatcaacgcctaaatatcatatggaagatgttcaccgagcaggtggtgtaatggctatccttggtgagttagatagagctgggcttctgaataatcaaacaaaaacggttcttggcttaaccatgcaagagcaacttgcacaatacgatattatgcaaactgaagacgaagagatccttaaattcttccgtgcaggacctgcagggatccgaacaacaaaagcattctcgcaagattgccgttgggatcgccttgatgacgaccgaaaagaagggtgtattcgaaccaaagaaaatgcctttagccaagaaggtggtctcgccgttctatctggcaatatagcggttgatggttgtattgtaaaaaccgccggcgttgatgaagaaaatctaaagttccaaggtccagccattgtttttgaaagccaagactcagcggtagaaggcattttaggtggaaaagttaaagcgggtgaagtcgttgttattcgctacgaaggtccaaagggtggtccaggtatgcaagaaatgctttacccaaccacttacttgaaatcaatgggcttaggcaaagcatgtgcgcttctaactgatggtcgattctctggtggtacatcaggcctatctataggtcacgcatctccagaagctgcaagtggtggcacaataggtttagttaacgatggtgatatcattaccatcgatatcccaagccgctcaattacgcttgatgtaccagaatcagaactgcaagctcgtcgagcgaaacaagatgaactcggttggaaacctgtgaatcgtcaacgtgaagtctcttttgcattaaaagcctatgcaagtatggcaacaagtgcagataaaggtgctgttcgtgataaatctaagttagaagggtaa

SEQ ID NO: 686 - protein, 613 aa, Vibrio fisheri
MPTYRSATTTHGRNMAGARALWRATGVKEDDFGKPIIAVVNSFTQFVPGHVHLKDMGQLVAGEIEKAGGIAKEFNTIAVDDGIAMGHGGMLYSLPSRELIADSVEYMVNAHCADAMVCISNCDKITPGMMMAAMRLNIPVIFVSGGPMEAGKTKLSDQIIKLDLVDAMIQGADPTVSDAQSEQIERSACPTCGSCSGMFTANSMNCLTEALGLSQPGNGSMLATHADREQLFINAGKRIVELTKRYYEQDDESALPRNIADRAAFENAMALDIAMGGSSNTVLHLLASAQEGEIDFDMGDIDEMSRRVPHLCKVAPSTPKYHMEDVHRAGGVMAILGELDRAGLLNNQTKTVLGLTMQEQLAQYDIMQTEDEEILKFFRAGPAGIRTTKAFSQDCRWDRLDDDRKEGCIRTKENAFSQEGGLAVLSGNIAVDGCIVKTAGVDEENLKFQGPAIVFESQDSAVEGILGGKVKAGEVVVIRYEGPKGGPGMQEMLYPTTYLKSMGLGKACALLTDGRFSGGTSGLSIGHASPEAASGGTIGLVNDGDIITIDIPSRSITLDVPESELQARRAKQDELGWKPVNRQREVSFALKAYASMATSADKGAVRDKSKLEG

SEQ ID NO: 687 - DNA, 1860 bp, Shewanella oneidensis
atgccaaagttacgatcagctaccagtacggaaggccgcaatatggcgggtgcccgtgcgctatggcgcgccaccggggtgaaagacaatgattttggtaagccgattattgcgattgccaactcctttactcagtttgttcccggccatgtgcacttaaaagatatgggctcactggtggcgagtgcgattgaagaggcgggcggtatcgccaaagaattcaatactatcgccgtcgacgatggtatcgccatgggccacggtggcatgctctacagtttgccctcgcgggagctgattgccgatagtgtggagtacatggtcaatgcccactgcgccgatgccttagtgtgtatctccaactgcgacaaaatcactcccggcatgttgatggcggcgctgcgtctcaatattcccgtggtatttgtgtcgggtgggccgatggaagcgggtaaaaccaaactgtcggacaaacttatcaagctcgatttagtcgatgccatggtggcggcggccgactcgagtgtgagcgatgaagatagcgccaaaatcgagcgcagtgcttgcccgacgtgtggttcctgttcgggcatgttcaccgccaactctatgaactgtttgaccgaagccctggggttatcgctgccgggcaacggctccatgctggcaacccatagcgatcgccgcgagctgtttttagaggcgggccggcgcgtgatggcgctgaccaagcgttattacgagcaagatgacacctcggcgctgccgcgtaatatcgcctgctttaaagcttttgagaacgccaccgcattagatatcgccatgggcggttcgtctaatactgtgttgcacttgttagcggcggcgcaggaggcggaagtcgcatttactatggacgatatcgaccgtatgtcgcgccttgtgccgcacctttgtaaagtcgccccatcgacgcctaaatatcatatggaagatgtgcaccgcgccggtggcgtgatgggcattttaggcgagcttgaccgcgccggattgctgcataccgatgtgccacacgttgccgccgatgcaggcggaaatctcaagtcggtgcttgccaagtacgatgtcatgcaaacccaagatgacaacgtaaaacaattctttatggcgggacctgcgggcatccccaccactaaagcctttagtcaagactgccgctggccatcgctggatgatgacaggcgagaagggtgtatccgcagccgcgaatttgcctttagccaagaaggcgggctggccgtgctgtcgggcaatttagctgaaaatggctgtattgttaaaacggcgggcgtggatgagtcgaatttgatttttgttggctcggctcgcgtctacgaaagccaagatgatgcggtggcgggcattttaggtggcgaagtagtggcgggcgatgtggtcgtcatccgttacgaagggccaaaaggtggtccgggtatgcaagaaatgttgtaccccaccagttacttaaaatcccgcggcttaggcaaggcctgcgcgctaatcaccgatggacgtttctctggtggaacatccggtttatccatcggccatgtgtcgcccgaggcggcggctggcggcacgattgccttgattgaaaacggcgatcgcattgaaatcgatatcccagcgcgcagtattaagctcgctgtgagcgatgccgagttagcggggcgtcgtgagaccatgttagcgcgtggtccaatggcgtggaagcctgttggtcgcgagcgttttgtatctatggcactaaaagcctacgccatgcttgccaccagtgccgataagggcgcggtgcgcgatcgcagcaagttggaggactga

SEQ ID NO: 688 - protein, 619 aa, Shewanella oneidensis
MPKLRSATSTEGRNMAGARALWRATGVKDNDFGKPIIAIANSFTQFVPGHVHLKDMGSLVASAIEEAGGIAKEFNTIAVDDGIAMGHGGMLYSLPSRELIADSVEYMVNAHCADALVCISNCDKITPGMLMAALRLNIPVVFVSGGPMEAGKTKLSDKLIKLDLVDAMVAAADSSVSDEDSAKIERSACPTCGSCSGMFTANSMNCLTEALGLSLPGNGSMLATHSDRRELFLEAGRRVMALTKRYYEQDDTSALPRNIACFKAFENATALDIAMGGSSNTVLHLLAAAQEAEVAFTMDDIDRMSRLVPHLCKVAPSTPKYHMEDVHRAGGVMGILGELDRAGLLHTDVPHVAADAGGNLKSVLAKYDVMQTQDDNVKQFFMAGPAGIPTTKAFSQDCRWPSLDDDRREGCIRSREFAFSQEGGLAVLSGNLAENGCIVKTAGVDESNLIFVGSARVYESQDDAVAGILGGEVVAGDVVVIRYEGPKGGPGMQEMLYPTSYLKSRGLGKACALITDGRFSGGTSGLSIGHVSPEAAAGGTIALIENGDRIEIDIPARSIKLAVSDAELAGRRETMLARGPMAWKPVGRERFVSMALKAYAMLATSADKGAVRDRSKLED

SEQ ID NO: 689 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 690 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 691 - DNA, 1680 bp, Klebsiella pneumoniae
atggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 692 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 693 - DNA, 1665 bp, Lactococcus lactis
atgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattga

SEQ ID NO: 694 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 695 - DNA, 1665 bp, Staphylococcus aureus
  CDS (1)..(1665)
atgactgataaaaagtacactgcagccgatatggttattgatactttgaaaaataatggggtagaatatgtttttggtattccgggtgcaaagatagactatctatttaatgctttaattgatgatggtcctgaacttattgtcactcgtcatgaacaaaatgctgcaatgatggcacaaggtattggaagattaacaggtaaaccgggtgtagtacttgttacaagtggccctggtgtaagtaatttaacgactggactattaacagctacatctgaaggggatcctgtattagcgttaggtggccaagtgaaacgtaatgatttattacgattaacgcatcaaagtattgataatgctgcgctattaaaatattcatcaaaatacagtgaagaagtacaagatcctgaatcattatcagaagttatgacaaatgcaattcgaattgctacttcaggaaaaaatggcgcaagttttattagtattccgcaagacgttatttcttcaccagttgaatctaaagctatatcactttgccaaaaaccaaatttaggagtaccgagtgaacaagatattaatgatgtcattgaagcgattaaaaatgcatcatttcctgttttattagctggtatgagaagttcaagtgcagaagaaacaaatgccattcgcaaattagttgagcgcacgaatttaccagttgtagaaacattccaaggtgcaggtgtaattagtcgtgaattagaaaatcatttcttcggtcgtgtgggcttattccgcaatcaagttggtgatgaattattacgtaaaagtgatttagttgttacaatcggttatgatccaattgaatacgaagctagtaactggaataaagaattagaaacacaaattatcaatattgacgaagttcaagctgaaattactaattatatgcaaccgaaaaaagagttgattggtaatattgctaaaacgattgaaatgatttctgaaaaagtggatgagccatttataaatcaacaacatttagacgaattagaacaattaagaacacatattgatgaagaaactggtattaaagcgacgcatgaagaaggaattctacatccagtggaaattattgaatctatgcaaaaggtattaactgatgatactactgtaacagttgatgttggaagtcactatatttggatggcacgtaatttcagaagttacaatccaagacatttattatttagcaatggtatgcaaacgcttggtgtagcattaccgtgggcaatttcagctgcacttgtgcgccctaatacgcaagttgtgtccgttgctggcgatggtggctttttattttcatcacaagatttagaaacggccgtacgtaaaaatttaaatatcatccagcttatttggaatgatggaaaatataacatggttgaattccaagaagaaatgaaatataaacgttcgtcaggtgtagacttcggtcctgtagattttgtaaaatatgcagaatcatttggcgcgaaaggtttacgagttactaatcaagaagaattagaagcggcaattaaagagggctatgaaacagatggtccagtattaattgatatacctgtaaattacaaagataatatcaaactttcaacaaatatgttacctgacgtatttaactaa

SEQ ID NO: 696 - protein, 554 aa, Staphylococcus aureus
MTDKKYTAADMVIDTLKNNGVEYVFGIPGAKIDYLFNALIDDGPELIVTRHEQNAAMMAQGIGRLTGKPGVVLVTSGPGVSNLTTGLLTATSEGDPVLALGGQVKRNDLLRLTHQSIDNAALLKYSSKYSEEVQDPESLSEVMTNAIRIATSGKNGASFISIPQDVISSPVESKAISLCQKPNLGVPSEQDINDVIEAIKNASFPVLLAGMRSSSAEETNAIRKLVERTNLPVVETFQGAGVISRELENHFFGRVGLFRNQVGDELLRKSDLVVTIGYDPIEYEASNWNKELETQIINIDEVQAEITNYMQPKKELIGNIAKTIEMISEKVDEPFINQQHLDELEQLRTHIDEETGIKATHEEGILHPVEIIESMQKVLTDDTTVTVDVGSHYIWMARNFRSYNPRHLLFSNGMQTLGVALPWAISAALVRPNTQVVSVAGDGGFLFSSQDLETAVRKNLNIIQLIWNDGKYNMVEFQEEMKYKRSSGVDFGPVDFVKYAESFGAKGLRVTNQEELEAAIKEGYETDGPVLIDIPVNYKDNIKLSTNMLPDVFN

SEQ ID NO: 697 - DNA, 1698 bp, Listeria monocytogenes
  CDS (1)..(1698)
atggcgaaactagaaaaagaccaagaaaaagtaataacacaagggaaatcaggagcggatttagttgtagacagcttaattaatcaaggtgttacgcatgtattcgggattccgggagcgaaaattgataaagtttttgatgtgatggaagaacgtggaccagaattaattgtcagtcgtcatgaacaaaatgcggcgtttatggctgctgctatcggtcgtctaaccgggaaacctggtgttgtacttgtaactagtggacctggcgcatcgaatcttgcaacagggcttgtaaccgcaactgcagaaggagatccagtcgttgcgattgctggtaacgtaacaaggcaagaccgcttaaaaagaacccaccaatcaatggataatgcagcacttttccgtccgattacaaaatacagcgaagaagtagttcacgccgaaagtattccagaagcaatcactaacgcttttcgctcggcaacagaaccaaaccaaggcgctgcttttgtcagtttgccacaagatatcgtgaacgaaccaaacgtaccagtaaaagcgattcgcccacttgctaaaccagaaaatggtcctgcttccaaagaacaagttgcaaaacttgttacacgtttgaaaaaagcgaaattaccggtattgctattgggtatgcgagcatctagtccagaagtaactggtgcaattcgtcgcttactccaaaaaacaagtatcccagtagtagaaactttccaagcagctggcgtcatttcacgcgacttagaagataacttctttggacgtgttggtctgttccgcaaccaaccaggggatattttgttaaataaagctgatttagttattacagtgggttatgatccaattgaatacgatccaaaagcttggaatgcctctggtgatagaacgattgtccatttagacgacattcgcgctgatattgatcattattaccaaccagtgacagagctagtcggaaacatcgcgcttactttagaccgagtgaatgcgaaattcagcggtttagaattagcggaaaaagaacttgaaacattaaaagaacttcatgctcaattagaagagcgagatgttccgccagaaagtgatgaaactaaccgagtacatccattgtcggtcattcaaacactacgttcggcaattgatgacaacgtaactgtgacagtcgacgttggttcacattatatttggatggcacgtcatttccgctcctatgaaccacgccgtctgcttttcagtaacggtatgcaaacgcttggtgttgcgcttccttggggaattgctgcaacacttgtacatccgggtgaaaaagtggtttcgatttctggtgacggtggtttcttattttccgcgatggaattagaaacagctgtccgcttgcgtgcgccacttgtacacctagtatggaatgacggaagctatgacatggttgctttccaacaaaaaatgaaatacggcaaagaagcagctgttcgttttggcgatgttgatatcgtaaaatttgcagaaagtttcggagcaaaaggtcttcgcgtaacaaatccagcagaactttctgatgtgttaaaagaagcgcttgaaacagaaggacccgtcgttgtagatattccaattgattaccgtgataacatcaaacttggcgaaactttactacctgaccaattttattaa

SEQ ID NO: 698 - protein, 565 aa, Listeria monocytogenes
MAKLEKDQEKVITQGKSGADLVVDSLINQGVTHVFGIPGAKIDKVFDVMEERGPELIVSRHEQNAAFMAAAIGRLTGKPGVVLVTSGPGASNLATGLVTATAEGDPVVAIAGNVTRQDRLKRTHQSMDNAALFRPITKYSEEVVHAESIPEAITNAFRSATEPNQGAAFVSLPQDIVNEPNVPVKAIRPLAKPENGPASKEQVAKLVTRLKKAKLPVLLLGMRASSPEVTGAIRRLLQKTSIPVVETFQAAGVISRDLEDNFFGRVGLFRNQPGDILLNKADLVITVGYDPIEYDPKAWNASGDRTIVHLDDIRADIDHYYQPVTELVGNIALTLDRVNAKFSGLELAEKELETLKELHAQLEERDVPPESDETNRVHPLSVIQTLRSAIDDNVTVTVDVGSHYIWMARHFRSYEPRRLLFSNGMQTLGVALPWGIAATLVHPGEKVVSISGDGGFLFSAMELETAVRLRAPLVHLVWNDGSYDMVAFQQKMKYGKEAAVRFGDVDIVKFAESFGAKGLRVTNPAELSDVLKEALETEGPVVVDIPIDYRDNIKLGETLLPDQFY

SEQ ID NO: 699 - DNA, 1680 bp, Streptococcus mutans
  CDS (1)..(1680)
atgaccgaaataaataaggaaggctatggggctgacctgattgtagacagcctcattaatcatgatgtcaactatgtttttggaatccctggtgcaaaaattgatcgtgtctttgataccttagaagataaggggccagaacttattgtagcacgccatgagcaaaatgctgcttttatggctcaaggaattggccgtattactggtgagcctggtgttgtgattacaaccagcggtcccggtgtttccaatctggtgactggtcttgttactgcgacagctgagggagatcctgtccttgctattggtggtcaggttaaacgtgctgatttgctcaaacgggctcaccagtcaatgaataatgttgctatgctcgatcccattaccaaatattcagcagaaattcaggatcccgcaacactttcagaaaatattgctaatgcctatcgtttggctaaagcaggaaagccgggagctagtttcttatctattcctcaagatataactgatagtcctgttactgtcaaggcgattaagcccttgacagatcctaaactaggttcagcgtcagttgctgatattaattatttggcacaggccataaaaaatgcggtccttcctgtcttacttttaggaaatggtgcgtcaacggctgcagttacagcttctattcgccgtttgttaggagctgtcaagctgccagtcgttgaaactttccaaggagctggtattgtttcaagagatttagaagaggacactttttttggtcgtgtggggctttttcgtaatcagcccggagatatgttgctgaagcgttctgacttagttatcgctattggctatgatcctattgaatatgaagcgcgcaattggaatgctgaaatttcggctcgcattatcgttattgatgttgctccagctgaaattgatacttatttccaacctgaacgtgaattaattggtgatatagctgaaacacttgatttactcctacctgctattagtggctactcacttccaaaaggttctcttgactatctcaaaggccttcgtgataatgtagtagaagatgtcaaatttgataagacagtcaaatccggtctggttcatccgcttgatgtgattgatgtccttcaaaagcaaacgactgatgatatgacagtaacggttgatgttggcagccattatatttggatggctcgttattttaaaagctatgaagcacggcacttacttttctcaaatggtatgcaaaccttaggtgttgctttgccttgggcaatttcggcagctcttgtacggccaaatgagaagattatttctatttcaggtgatggtggtttcctcttttctggccaagaattggaaacagctgttcgtttacatttaccaattgttcatatcatttggaatgatggtaaatataatatggttgaattccaagaagaaatgaaatacggccgttcagcaggtgttgattttggtcctgttgattttgtcaagtatgctgatagtttcggtgctaaaggttaccgtgctgatagtaaagaaaagtttgatcaagttcttcaaacagcactcaaggaagctgcaaatggcccagttctcattgatgttccaatggactataaagataatgtaaaattgggtgaaactattttgcctgatgaattctactaa

SEQ ID NO: 700 - protein, 559 aa, Streptococcus mutans
MTEINKEGYGADLIVDSLINHDVNYVFGIPGAKIDRVFDTLEDKGPELIVARHEQNAAFMAQGIGRITGEPGVVITTSGPGVSNLVTGLVTATAEGDPVLAIGGQVKRADLLKRAHQSMNNVAMLDPITKYSAEIQDPATLSENIANAYRLAKAGKPGASFLSIPQDITDSPVTVKAIKPLTDPKLGSASVADINYLAQAIKNAVLPVLLLGNGASTAAVTASIRRLLGAVKLPVVETFQGAGIVSRDLEEDTFFGRVGLFRNQPGDMLLKRSDLVIAIGYDPIEYEARNWNAEISARIIVIDVAPAEIDTYFQPERELIGDIAETLDLLLPAISGYSLPKGSLDYLKGLRDNVVEDVKFDKTVKSGLVHPLDVIDVLQKQTTDDMTVTVDVGSHYIWMARYFKSYEARHLLFSNGMQTLGVALPWAISAALVRPNEKIISISGDGGFLFSGQELETAVRLHLPIVHIIWNDGKYNMVEFQEEMKYGRSAGVDFGPVDFVKYADSFGAKGYRADSKEKFDQVLQTALKEAANGPVLIDVPMDYKDNVKLGETILPDEFY

SEQ ID NO: 701 - DNA, 1683 bp, Streptococcus thermophilus
  CDS (1)..(1683)
gtgttcatgtcagaagaaaagcaattgtatggtgcagatttagtggttgatagtttgatcaaccatgatgttgagtatgtctttgggattccaggcgcaaaaatcgatagggtttttgataccttggaagataagggacctgaattgattgttgcccgtcatgagcaaaatgctgcttttatggctcaaggtgttggacgtattactgggaaaccaggtgtagtattggtaacatctggtccaggtgtctccaatttggctactggtttggtaacagcgacggatgaaggagaccctgttcttgctattggtggtcaggttaagcgtgcagatctcttgaaacgtgcccaccaatcaatgaataacgttgctatgcttgagccaattaccaaatatgctgctgaagtacatgatgctaacaccctttctgaaacggttgctaatgcctatcgtcacgctaagtcagggaaaccaggtgcaagcttcatttcaattcctcaagacgtgacggatgctccggtcagtgttaaggctattaagcctatgacagatccaaaacttggttcagcatctgtttctgatattaactatctagcacaagccattaaaaatgcagtgttgccagtctttcttttggggaatggtgcctcatcagaagccgtaacttactctattcgccaaattttgaagcatgttaaattgccagttgttgaaactttccaaggtgccggtatcgtgtcacgtgaccttgaagaagatactttctttggtcgtgtaggtcttttccgtaaccaacccggagacatgttgcttaaaaaatccgacttagttattgccattggttatgatccaatcgaatatgaagcacgtaactggaatgctgaaatttcagcacgtatcatcgttattgatgtcgagccggccgaggtggacacttacttccaaccggaacgtgaattgattggtaatgtagaagcgagcttagacttgcttttgcccgctattcaaggttataaattgcctgaaggtgcggttgaatatcttaaaggtttgaaaaacaatgttgttgaggatgttaagtttgaccgtcagcctgatgaaggtacggtgcatccgctagatttcatcgaaaatttgcaagaacacacagatgatgatatgactgttacgtttgatgttggtagtcactatatttggatggcacgttatctcaaatcgtatgaaccacgtcatttgcttttctcaaatgggatgcaaacgataggtattgctattacatgggctatctctgcagcattggttcgtcctaagacaaaagtgatttctgtatctggtgatggtggtttcctcttctcagcacaagaattggaaacagcagttcgtttgaaattgccaattgtccatattatctggaacgatggtcattacaatatggtggaattccaggaagaaatgaagtacggtcgttcatctggggttgactttggtcctgtagattttgtaaaatatgctgagagctttggagccaaaggttatcgtgcaacaagtaaagcagcgtttgctagcttgcttcaagaggctttgactcaggctgtagatggaccagtccttattgatgttccaattgactataaagataacattaaactcggcgaaactattttgccagatgaattttactaa

SEQ ID NO: 702 - protein, 560 aa, Streptococcus thermophilus
VFMSEEKQLYGADLVVDSLINHDVEYVFGIPGAKIDRVFDTLEDKGPELIVARHEQNAAFMAQGVGRITGKPGVVLVTSGPGVSNLATGLVTATDEGDPVLAIGGQVKRADLLKRAHQSMNNVAMLEPITKYAAEVHDANTLSETVANAYRHAKSGKPGASFISIPQDVTDAPVSVKAIKPMTDPKLGSASVSDINYLAQAIKNAVLPVFLLGNGASSEAVTYSIRQILKHVKLPVVETFQGAGIVSRDLEEDTFFGRVGLFRNQPGDMLLKKSDLVIAIGYDPIEYEARNWNAEISARIIVIDVEPAEVDTYFQPERELIGNVEASLDLLLPAIQGYKLPEGAVEYLKGLKNNVVEDVKFDRQPDEGTVHPLDFIENLQEHTDDDMTVTFDVGSHYIWMARYLKSYEPRHLLFSNGMQTIGIAITWAISAALVRPKTKVISVSGDGGFLFSAQELETAVRLKLPIVHIIWNDGHYNMVEFQEEMKYGRSSGVDFGPVDFVKYAESFGAKGYRATSKAAFASLLQEALTQAVDGPVLIDVPIDYKDNIKLGETILPDEFY

SEQ ID NO: 703 - DNA, 1665 bp, Vibrio angustum
  CDS (1)..(1665)
atgtcggataaaaccgtctctggtgctgaactggttgttgaaactttaaatgcacataacgttccacacatttttggtattcctggagcaaaggtggatgctgttttcgatgctgtttgtgataacggaccagaaatcattatttgtcatcatgaacaaaatgcagcgtttatggcagcagcaactgggcgtttaacgggtaaagcaggcatttgtttagcaacctctggaccaggcgcatcaaaccttgtcacaggcgttgcaacagcgaatagtgaaggtgatcctgtggttgcacttgcaggtgctgtacctctttctatgtattctcacaatactcatcaatccatggatacccgttcactgtttactcctatcaccaagttttcagcagaagtgatggatagcagctcggtatctgatgttgtacataaagcttttcgtattgcagagcaacctacccaaggtgctagctttgttagtctaccgcaagatattctaactaaccgtattccttaccagccagtacaacagcctaatccaattttgttcggtggtgcacacccacaagctattcgtcaggctgctgatcgcattaatgctgcaaaaaatccggtgttattactgggcatggatgcaagccagccttttgttgctgatgctattcgccaactactcaaacaaacaccaattgccgttgtgaatacgtttgccgcagctggggttatttctcatgatttatacaactgctttttaggtcgtgttggcttatttaaaaatcaacccggtgatattgcattaaacagtgcagatttaatcattaccattggctacagcccaattgaatacgatccgattctttggaataaagatgcaaacacaccaattattcatattggttatcaacaagcagatttagaaattagctataaccctgtttgtgaagttgtgggtgacttagcggtgtctgtcacgtctattgcttctgaattagataagcgagaatcattagaaaataaccaacaaatccaattattacgccacgatttacaacatattatgcagatgggggtaaataaaacctcaacaaacggcgttcacccgcttcgttttgttcatgagttacgtcgctttgttagtgacgacaccactgtatgttgtgatgtaggctctatttatatttggatggcacgttacttccacagctttgaacctcgtcgtttattgttcagcaatggccaacaaacattgggcgtagctttaccttgggcaattgcagcttcccttcttcaccctaatgaaaaagtaatttccatgtctggtgatggtggcttcctattctcatcaatggaattagccacggccgttcgccataaatgtaatatcgttcactttgtttggacagatcacagttatgacatggttaagatccaacagcttaaaaagtatggtcgagagagtgccgtcagctttataggtcctgatattgttaagtacgcagaaagcttcggcgcacatggtttagcgatcaatactgccgatgatattgagcctgttatgcgaaaagctatgagcttaagtggcccagtattggtcaacgtcaatgttgattatagcgataacagtcgcctacttgatcaacttcatccatgccaacaagattaa

SEQ ID NO: 704 - protein, 554 aa, Vibrio angustum
MSDKTVSGAELVVETLNAHNVPHIFGIPGAKVDAVFDAVCDNGPEIIICHHEQNAAFMAAATGRLTGKAGICLATSGPGASNLVTGVATANSEGDPVVALAGAVPLSMYSHNTHQSMDTRSLFTPITKFSAEVMDSSSVSDVVHKAFRIAEQPTQGASFVSLPQDILTNRIPYQPVQQPNPILFGGAHPQAIRQAADRINAAKNPVLLLGMDASQPFVADAIRQLLKQTPIAVVNTFAAAGVISHDLYNCFLGRVGLFKNQPGDIALNSADLIITIGYSPIEYDPILWNKDANTPIIHIGYQQADLEISYNPVCEVVGDLAVSVTSIASELDKRESLENNQQIQLLRHDLQHIMQMGVNKTSTNGVHPLRFVHELRRFVSDDTTVCCDVGSIYIWMARYFHSFEPRRLLFSNGQQTLGVALPWAIAASLLHPNEKVISMSGDGGFLFSSMELATAVRHKCNIVHFVWTDHSYDMVKIQQLKKYGRESAVSFIGPDIVKYAESFGAHGLAINTADDIEPVMRKAMSLSGPVLVNVNVDYSDNSRLLDQLHPCQQD

SEQ ID NO: 705 - DNA, 1689 bp, Bacillus cereus
ttgagtacaggtgtaaaagcaaacgacgtgaagacaaaaacaaaaggagcagatcttgttgttgattgtttaattaaacaaggtgttacacatgttttcggtattccaggagcaaagattgactctgtatttgatgtactgcaagaaagaggaccagagttaattgtttgtcgtcatgaacaaaatgcagcatttatggcagctgctattggtagattaacaggaaaaccgggcgtatgtcttgtaacttcaggaccagggacatcaaatttagcgacaggtcttgttactgcgaatgcggagagtgatcccgttgttgctttagctggtgcagttccgcgtacggatcgattaaaacgtacacatcaatctatggataatgctgcactattcgaaccaatcacaaaatatagcgtagaagtagagcatcctgataatgtgccagaagcattatcaaatgcattccgaagtgcgacttctacaaatccaggagcaactttagtaagtttgccgcaagacgttatgactgcggaaacgactgtagagtctatcggtgcgctttctaagccacagcttggaatcgctcccacacatgatattacatatgtagtagataaaataaaagcagcgaaattaccagttattttactcggtatgagagcgagcacaaatgaagtgacgaaagccgttcgtaaattaattgcggatacagaacttcctgtcgttgaaacatatcaagcggctggtgccatttcacgtgagttagaagatcatttcttcggccgtgttggactattccgtaaccaaccaggtgatattttactagaagaggcagatcttgttatttctatcggttatgatccaattgagtatgatccaaagttctggaataaacttggagacagaacgattattcatcttgatgaccatcaagcagatatagatcatgattaccaaccagagcgtgaattaattggtgatattgccttaacagtaaatagcatcgcagaaaagttaccgaaacttgtgttaagtacgaaatcagaagcagtgttagaacgattacgcgcgaaattatcagaacaagcagaagttccaaatcgtccttcagaaggtgttacacatccgcttcaagtgattcgtacacttcgttctttaattagtgacgacacaaccgttacatgtgacatcggttcccattctatttggatggcgagatgtttccgttcttatgaaccacgtagattattatttagtaacggtatgcagacgttaggtgttgcacttccttgggcaattgctgctactttagtagaaccaggtaaaaaagtagtttccgtatcaggtgacggtggtttcttattctcagcgatggagttagaaacggcggtacgtttaaattctccaatcgtccatcttgtttggagagacggcacatatgatatggttgcattccaacaaatgatgaaatacggcagaacatcagctacagagtttggtgatgttgatcttgttaaatatgcggaaagtttcggggcgttaggtcttcgtgttaacacgcctgatgaattagaaggggtattgaaagaagcactagcagcagacggccctgtcattattgatattccaattgactatcgtgacaacattaaattaagcgaaaaattattaccaaaccaattaaactaa

SEQ ID NO: 706 - protein, 562 aa, Bacillus cereus
MSTGVKANDVKTKTKGADLVVDCLIKQGVTHVFGIPGAKIDSVFDVLQERGPELIVCRHEQNAAFMAAAIGRLTGKPGVCLVTSGPGTSNLATGLVTANAESDPVVALAGAVPRTDRLKRTHQSMDNAALFEPITKYSVEVEHPDNVPEALSNAFRSATSTNPGATLVSLPQDVMTAETTVESIGALSKPQLGIAPTHDITYVVDKIKAAKLPVILLGMRASTNEVTKAVRKLIADTELPVVETYQAAGAISRELEDHFFGRVGLFRNQPGDILLEEADLVISIGYDPIEYDPKFWNKLGDRTIIHLDDHQADIDHDYQPERELIGDIALTVNSIAEKLPKLVLSTKSEAVLERLRAKLSEQAEVPNRPSEGVTHPLQVIRTLRSLISDDTTVTCDIGSHSIWMARCFRSYEPRRLLFSNGMQTLGVALPWAIAATLVEPGKKVVSVSGDGGFLFSAMELETAVRLNSPIVHLVWRDGTYDMVAFQQMMKYGRTSATEFGDVDLVKYAESFGALGLRVNTPDELEGVLKEALAADGPVIIDIPIDYRDNIKLSEKLLPNQLN

SEQ ID NO: 707 - DNA, 2034 bp, Candida glabrata
atgacgagaagagggctaacggatccaatgatacgtattagtggggtagtagcgagagcatgccgtcgtagtgcggcgtatcaggtttgcaagtacagtgtgcgggcggttcccaggccggagccctcgccgagtttcaatgttgatcccgatacagcggctgctaataccgggagtggtgtgaagttgagttctaagctgaagaatgtggcgacgcagaagatggacaactcgtttgtgggtctgaccggtgggcagattttcaacgagatgatggcgcgcaacaatgtggacactgtgtttgggtaccctggtggtgcgatcttgccggtgtacgatgcgatccacaactccgacaagttcaagtttgtgttgcctaagcacgagcaaggtgcgggccacatggccgagggttacgcaagggcctccggtaagccaggtgtcgtgttggttacttcgggtcctggtgccacgaacgttgtgactcccatggccgatgcgctggctgacggtattcctatggttgtgtttacgggccaagtgcccaccactgccattggtaccgatgcgttccaagaagccgacattgttggtatctccagatcctgtacaaaatggaacgtgatggtgaagaacgtagcggagctgccactgagaatcaacgaggccttccagattgccacgagcggcagacccggcccagtgttggtggacttgccaaaggacgtcacagccgccatcctgagaacaccaatcccagttaagagcaccctgccatcaaccgcattgcaacagttgactgcaggtgtccaggaccaattcgttattgaaaacatcaagaaatctgccgacttgataaatatcgccaagaatccagtcctttacgtcggtggtggtatcctgaacaatgtcgatgggccaagattggtcaaagagctaagtgagcgtgcgcagatcccagttaccactactttacaaggtttgggtgcattcgaccaagaagatccaaagtctctagacatgctgggtatgcatggttgtgccactgcaaaccttgccgtccagaactccgacttgatcatcgccgtcggtgccagattcgacgaccgtgtcaccggtaacatcactaagtttgcaccagaagcaagaaaggccgcattggaaggtagaggtggtatcattcactttgaaatcactccaaagaacataaataaagtcgtagaagcacaagtggcagtagaaggtgacgctgcttccaacttatccaagttgatcccattggtattcccagtgaaggaaagaccagaatggttcgaaaagattaataagtggaagaaggaattcccatacagttactccctagagactccaggttctagaatcaaaccacaaactgccattgccaagttgtcaaagattgccaatgctaccagcaaggaagttattgttacaaccggtgtcggccaacatcaaatgtgggctgctcaacactggacatggaagaacccacgtactttcatcacttctggtggtctaggtaccatgggttacggtttgccatctgctatcggtgcccaagtcgctaagccagacgccttagtcattgacattgacggtgatgcttctttcaacatgtccttacaggaactaagttctgctgtgcaagctaatgctcctgtaaaaattctagtgctaaacaacgaagagcaaggtatggtcacccaatggcaatctctattctacgagcatcgttactcacacacacatcaattgaacccagatttcgtaaaacttgcggaggcaatgggtatgaagggtatgagagtgaaagaccaagccgagcttgaaaagactctaaaagagtttgttgactaccagggtccagtcttgcttgaagtcgaagtagagaagaaggtgccagtcttgccaatggtcccagccggtaagggtttacacgaatttattaactacgacccagaaatggaaagggaacagaacgaactacgtcacaagcgtaccggtggtaagcattaa

SEQ ID NO: 708 - protein, 677 aa, Candida glabrata
MTRRGLTDPMIRISGVVARACRRSAAYQVCKYSVRAVPRPEPSPSFNVDPDTAAANTGSGVKLSSKLKNVATQKMDNSFVGLTGGQIFNEMMARNNVDTVFGYPGGAILPVYDAIHNSDKFKFVLPKHEQGAGHMAEGYARASGKPGVVLVTSGPGATNVVTPMADALADGIPMVVFTGQVPTTAIGTDAFQEADIVGISRSCTKWNVMVKNVAELPLRINEAFQIATSGRPGPVLVDLPKDVTAAILRTPIPVKSTLPSTALQQLTAGVQDQFVIENIKKSADLINIAKNPVLYVGGGILNNVDGPRLVKELSERAQIPVTTTLQGLGAFDQEDPKSLDMLGMHGCATANLAVQNSDLIIAVGARFDDRVTGNITKFAPEARKAALEGRGGIIHFEITPKNINKVVEAQVAVEGDAASNLSKLIPLVFPVKERPEWFEKINKWKKEFPYSYSLETPGSRIKPQTAIAKLSKIANATSKEVIVTTGVGQHQMWAAQHWTWKNPRTFITSGGLGTMGYGLPSAIGAQVAKPDALVIDIDGDASFNMSLQELSSAVQANAPVKILVLNNEEQGMVTQWQSLFYEHRYSHTHQLNPDFVKLAEAMGMKGMRVKDQAELEKTLKEFVDYQGPVLLEVEVEKKVPVLPMVPAGKGLHEFINYDPEMEREQNELRHKRTGGKH

SEQ ID NO: 709 - DNA, 2076 bp, Kluyveromyces lactis
atgctcagtcagaggtttgtaacgcgggctttggccagacgtgcttttggtaagacatgcttgaaattaggaagtgcaagtgcaagtgcaagtaacgctgcttctgctgctgccggtgaggctagtagcaggccacagcctgctcctagctttaacgctgatatagctggtggttcttctggcggtgccagaagaaaccagatcccattgtcgaagagatcgagaatcgcagacaagaatactggtgtcaacattcaaaaccagatggatgattcgttcattggaatgaccggtggtgagatcttccacgagatgatgcaacgtcacaacgtcgacaccgtttttggataccctggtggtgcgattttgcccgtgtacgacgcaatctacaactcagataaattcacttttgttctaccaaaacatgaacaaggtgcaggtcacatggcagagggatacgcaagagcctcagggaaaccaggtgttgttttggtgacttcaggtccaggtgcgactaatgtggtgactcctatggcagatgcattggcagacggtgtgccgttggtggtgtttacaggtcaagtggccacgtcagctatcggaacagatgctttccaagaagcagatgtggttggtatctctagatcttgtaccaaatggaacgtgatggtgaaaaccattgaggaactgcctcgtagaatcaacgaagcgtttgaaatcgcaacttccggtagaccgggccccgttttggtggatttaccaaaggacgtgacggcggcggtgctaagaaacccaattccaatgaagtctattctaccatctgatactctaaatcagttgactcaaagagtcgtcgatgagttcactttggaaaacattagcagggctgctgacttgatcaacagggctaagaagcctttgctatacgtgggtgctggtattctaggcagcgaaatgggtcctcaatacttgaagcaactaagtgacagagctcagatcccagtcaccacgactctacaaggtcttggtgcgttcaaccaagaagatcataaatctttggatatggtcggtatgcacggtaatgctgcagccaacttggccatccaaaacgccgatttgatcattgcattgggtgccagatttgacgatcgtgtcactctgaatatttccaaatttgctccagaggctagaaaggctgctctagagaaacgtggtggtatcgttcatttcgaaatctccccaaagaatatcaacaaggttgtcgaagccgaggtcgctgtcgaaggtgatgtgactcgtaacttggaaaaattgttgccattggtcgaatctgttcctgaaagaccagaatggtccgctcaagtggctaaatggaaacaagaatacccatacgcgtaccaaaaggagactccaggttctaagattaaacctcaaaccgttatctccaagttgtccgatttggtcttgaaatccggtagaccagccatcgtcaccactggtgtcggtcaacatcaaatgtgggctgctcaacactggacttggaaaagtccaagatctttcatcacttccggtggtcttggtaccatgggttacggtctaccagctgctatcggtgctcaagtcgccagacctgacgctatcgtcatcgatatcgacggtgatgcctctttcaacatgactctgatggaattgtcctccgctgttcaagctcgtacaccagtcaaggtcttgttgctaaataacgaggaacaaggtatggttacccaatggcaatctctcttctacgaacaccgttactcgcatacccatcaactgaatccagatttcgttaaattggccgaagctatgggtctgaaggctctcagactctcgaaacaagaggacactgacgccatcttgaaagaattcgttgactacgagggcccaatcttattggaagtgcaaatcgaaaagaaggttcctgtcttgccaatggtcccaaccggtaagggtctacacgaattcatcaactttgatccagaagtagaaaaggaacaaaacgaactacgtcacaaacgtactagtggtaaatattga

SEQ ID NO: 710 - protein, 691 aa, Kluyveromyces lactis
MLSQRFVTRALARRAFGKTCLKLGSASASASNAASAAAGEASSRPQPAPSFNADIAGGSSGGARRNQIPLSKRSRIADKNTGVNIQNQMDDSFIGMTGGEIFHEMMQRHNVDTVFGYPGGAILPVYDAIYNSDKFTFVLPKHEQGAGHMAEGYARASGKPGVVLVTSGPGATNVVTPMADALADGVPLVVFTGQVATSAIGTDAFQEADVVGISRSCTKWNVMVKTIEELPRRINEAFEIATSGRPGPVLVDLPKDVTAAVLRNPIPMKSILPSDTLNQLTQRVVDEFTLENISRAADLINRAKKPLLYVGAGILGSEMGPQYLKQLSDRAQIPVTTTLQGLGAFNQEDHKSLDMVGMHGNAAANLAIQNADLIIALGARFDDRVTLNISKFAPEARKAALEKRGGIVHFEISPKNINKVVEAEVAVEGDVTRNLEKLLPLVESVPERPEWSAQVAKWKQEYPYAYQKETPGSKIKPQTVISKLSDLVLKSGRPAIVTTGVGQHQMWAAQHWTWKSPRSFITSGGLGTMGYGLPAAIGAQVARPDAIVIDIDGDASFNMTLMELSSAVQARTPVKVLLLNNEEQGMVTQWQSLFYEHRYSHTHQLNPDFVKLAEAMGLKALRLSKQEDTDAILKEFVDYEGPILLEVQIEKKVPVLPMVPTGKGLHEFINFDPEVEKEQNELRHKRTSGKY

SEQ ID NO: 711 - DNA, 2007 bp, Ashbya gossypii
atgttaaggagagtaaccgtaagacaactagctaacgtgcgggcgttggcacgagcgacacggccgttggcagtggcgcgagccttttctggggccgcagggcggctgggcgcggaagcgcaagaagcgcctaggaggcgggcgccggggccccgcggagagacggagccgcagggtgcagcgggcgcgcacgagatggaccactcgatgatcgggttcagcggcggagagatttttcacgagatgatgcggcgccataacgtggatacggtgtttgggtacccaggcggggccatcctgccggtgtacgatgccatatacaactcggacgcgttcaactttgtgctcccgaagcacgagcagggggcgggtcacatggcggagggctacgcgcgtgcttctgggaagccgggcgtcgtgttggtgacatcggggccgggggcgaccaacgtggtgacgccgatggcggatgcgctggccgacggagtaccgatggtggtcttcaccgggcaggtgcctaaagccgcaattggcacggatgcgttccaggaagccgatgtggtcggcatttcgcgctcgtgcaccaagtggaacgtgatggtgaatcacgtggaggagctcccgcggcgcatcaacgaagcttttgagattgcgacctctggtaggcccggcccggtgcttgtggacctcccgaaggacgtgaccgccgcgattttacgcagtcccatcccactggcctctgcgctaccgtcgacgaccctagcacagctcacacggcaggcggctgacatcgacggcgtgcgctcgcttgccgacgcatcgcggctcatcaatatggcacagaagccggtactctacgtgggtgcaggaatcctgaacagcactcgcggtccagagtttctgcgtgaactggctgaaaaggcacagatccccgtcacgacgacgttgcaagcgctgggtgcattcgaccaggaggattcgaagtccgtagatatgctgggcatgcacgggagtgcggctgccaatttgactgtgcagaatgcagacctgatcattgcgctgggcgcacggtttgatgaccgcgtgaccggaaacatcgctaagttcgccccggaggcccagcgggcggcccgtgaacagcgcggtgggatagtgcactttgagatctccccaaaaaatatcaacaaggtggttgacgctcaggtggcagtcgagggtgatgtgactgccaacctggaaaagctgctccccttgatcaagccggtcgctgagcgcaaagagtggctcggccagatcgcaagttggaagagcgagtatccatatgattactcgcgcgagacgcccggctcgcgcatcaagcctcagacagttatcactcggctctccgaaatcgcaaacgccaccggaaaggaggtcatcgtgacgaccggtgtaggtcagcaccaaatgtgggccgcccagcattggacgtggaagaaaccacgcacatttatcacatcaggcggcctcggtaccatgggctttggtctaccggcggccattggtgcccaggtagccaaacccgatgcgattgtcatcgacatcgatggcgacgcctcgctcaacatgaccttgatggagatgtccagcgcggtgcaggcgggcgccccagtaaagatattgttgttgaacaacgaagagcagggaatggtcactcaatggcagtctctattctacgagcatcgttattctcacacccatcagctaaatccggacttcgtcaagttggctgatgcaatggggttcaaagcaatgcgcctagaggcgcagtcggacatggagcccatgctgcaggagtttattaattgcaaggagcccgtgttactcgaagtggccgtcgagaagaaggttcccgtcctcccgatggtccctgccggtaaggccctgcatgagtttatctacttcgacccagaggtcgagcgacagcaagcggagcttcgcagcaggcgtacgggcgggaagcattag

SEQ ID NO: 712 - protein, 668 aa, Ashbya gossypii
MLRRVTVRQLANVRALARATRPLAVARAFSGAAGRLGAEAQEAPRRRAPGPRGETEPQGAAGAHEMDHSMIGFSGGEIFHEMMRRHNVDTVFGYPGGAILPVYDAIYNSDAFNFVLPKHEQGAGHMAEGYARASGKPGVVLVTSGPGATNVVTPMADALADGVPMVVFTGQVPKAAIGTDAFQEADVVGISRSCTKWNVMVNHVEELPRRINEAFEIATSGRPGPVLVDLPKDVTAAILRSPIPLASALPSTTLAQLTRQAADIDGVRSLADASRLINMAQKPVLYVGAGILNSTRGPEFLRELAEKAQIPVTTTLQALGAFDQEDSKSVDMLGMHGSAAANLTVQNADLIIALGARFDDRVTGNIAKFAPEAQRAAREQRGGIVHFEISPKNINKVVDAQVAVEGDVTANLEKLLPLIKPVAERKEWLGQIASWKSEYPYDYSRETPGSRIKPQTVITRLSEIANATGKEVIVTTGVGQHQMWAAQHWTWKKPRTFITSGGLGTMGFGLPAAIGAQVAKPDAIVIDIDGDASLNMTLMEMSSAVQAGAPVKILLLNNEEQGMVTQWQSLFYEHRYSHTHQLNPDFVKLADAMGFKAMRLEAQSDMEPMLQEFINCKEPVLLEVAVEKKVPVLPMVPAGKALHEFIYFDPEVERQQAELRSRRTGGKH

SEQ ID NO: 713 - DNA, 1998 bp, Pichia stipitis
atggccagagctgcactttcaaggagctccggttcccgatacgccatcagagccctctctaacaccaaattgcacaacgctaccatgtcagctacttccagacctactcctctgccagcattcaatgctgcagacatcagacagccacaatcttaccctacccagcgcaaaaagaacgactttgtcatggacgactccttcatcgggcttactggaggtgaaatcttccacgaaatgatgctcaggcacaacgtcgataccgttttcggctacgctggtggtgccatcttgccagtcttcgatgccatctacaactcagacaagttcaaatttgttcttcccagacacgagcagggtgctggccatatggctgaaggttacgcccgtgccaccggcaagcctggtgttgtccttgtgacttctggaccgggtgctaccaacgtcatcacgccattggctgatgctctcatggacggtgttccattggttgtattcacaggtcaagtacctaccactgccattggtactgatgccttccaggaagccgatgtcgttggtatctcgcgtagttgtaccaaatggaacgttatggtcaagaatgttgctgagttgcccagaagaatcaacgaggccttcgagattgctacttctggaagaccaggtcctgtcttggtcgatttgccaaaggacgttactgctgctatcttgagagaagccattcccatcaactcgaccttaccttctaatgctcttcagcagattactaaggaggcccaaaacgagttcaccatgggtgccattgctcgttcggccaacttgttgaacgtagccaagaagccaatcatctacgccggtgccggtgttctcaaccacgaggatggtcccaagttgttgaaggagttgtctgacaaggccaacattcccgtcacgaccaccttacaaggtcttggagcctttgaccaaagagaccctaagtccttggacatgttgggaatgcacggacacgctgctgccaacactgccatgcaagatgccgattgtataattgctcttggtgccagatttgacgacagagtcactggtaatatcaacaagttcgccccagaagctaaactcgctgcttcggaaggcagaggtggtatcatccactttgaaatttctcccaagaacatcaacaaggtcgtagaagccacagaagctgtggaaggagacctcactgctaacttgcgttctttcattccattggttaagcctgtggctgaaagaccacaatggttgggtaaaatcaacgaatggaaagagaagtacccatatgcctaccagcttgagactccaggctctttaatcaagccccagaccttgatcaaagaaatctctgaacagtcttctacttacaacaaggaagtcatcgtcaccaccggtgtcggccagcatcagatgtgggcagcccaacatttcacatggaccaaacctagaaccatgatcacatctggtggtttgggaaccatgggttatggattgcctgctgccattggtgcccaaatcggtaaacccgatgccattgtcatcgatattgatggagatgcctcgttcaacatgactcttaccgaattgtcttcagctgtgcaagctggagctccggtcaaggtctgtgtcttgaacaacgaagaacagggtatggtgacacaatggcagtctcttttctacgaacacagatactctcacacccaccaaagcaacccagacttcatgaagttggctgatgccatgggagtgcaaggaatcagaatttccacacaggaagagttaaagagcggagtgaaagccttcttggatgctaagggccctgttttgttggaagtcattgtcgaaaagaaggtgccagtcttgcctatggtgccagctggaagtgcattagacgacttcatcctctgggacgctgaaaccgaaaaacagcaaaaggaattgagaaatgaaagaactggtggaaagcattaa

SEQ ID NO: 714 - protein, 665 aa, Pichia stipitis
MARAALSRSSGSRYAIRALSNTKLHNATMSATSRPTPSPAFNAADIRQPQSYPTQRKKNDFVMDDSFIGLTGGEIFHEMMLRHNVDTVFGYAGGAILPVFDAIYNSDKFKFVLPRHEQGAGHMAEGYARATGKPGVVLVTSGPGATNVITPLADALMDGVPLVVFTGQVPTTAIGTDAFQEADVVGISRSCTKWNVMVKNVAELPRRINEAFEIATSGRPGPVLVDLPKDVTAAILREAIPINSTLPSNALQQITKEAQNEFTMGAIARSANLLNVAKKPIIYAGAGVLNHEDGPKLLKELSDKANIPVTTTLQGLGAFDQRDPKSLDMLGMHGHAAANTAMQDADCIIALGARFDDRVTGNINKFAPEAKLAASEGRGGIIHFEISPKNINKVVEATEAVEGDLTANLRSFIPLVKPVAERPQWLGKINEWKEKYPYAYQLETPGSLIKPQTLIKEISEQSSTYNKEVIVTTGVGQHQMWAAQHFTWTKPRTMITSGGLGTMGYGLPAAIGAQIGKPDAIVIDIDGDASFNMTLTELSSAVQAGAPVKVCVLNNEEQGMVTQWQSLFYEHRYSHTHQSNPDFMKLADAMGVQGIRISTQEELKSGVKAFLDAKGPVLLEVIVEKKVPVLPMVPAGSALDDFILWDAETEKQQKELRNERTGGKH

SEQ ID NO: 715 - DNA, 2046 bp, Yarrowia lipolytica
atgcaatcgcgactcgcccgacgggccactaacctggccagaatctccagatccaagtattctcttggtctgcgatatgtttccaacacaaaagcccctgctgcccagccggcaactgctgaacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagtggcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaa

SEQ ID NO: 716 - protein, 681 aa, Yarrowia lipolytica
MQSRLARRATNLARISRSKYSLGLRYVSNTKAPAAQPATAERSQPAPHFQGTVGKPPILKKAEAANADMDESFIGMSGGEIFHEMMLRHNVDTVFGYPGGAILPVFDAIHNSEYFNFVLPRHEQGAGHMAEGYARASGKPGVVLVTSGPGATNVITPMQDALSDGTPMVVFTGQVLTSVIGTDAFQEADVVGISRSCTKWNVMVKNVAELPRRINEAFEIATSGRPGPVLVDLPKDVTAAILREPIPTKSTIPSHSLTNLTSAAATEFQKQAIQRAANLINQSKKPVLYVGQGILGSEEGPKLLKELAEKAEIPVTTTLQGLGAFDERDPKSLHMLGMHGSGYANMAMQNADCIIALGARFDDRVTGSIPKFAPEARAAALEGRGGIVHFEIQAKNINKVVQATEAVEGDVTESVRQLIPLINKVSAAERAPWTETIQSWKQQFPFLFEAEGEDGVIKPQSVIALLSDLTENNKDKTIITTGVGQHQMWTAQHFRWRHPRTMITSGGLGTMGYGLPAAIGAKVARPDCDVIDIDGDASFNMTLTELSTAVQFNIGVKAIVLNNEEQGMVTQWQSLFYENRYCHTHQKNPDFMKLAESMGMKGIRITHIDQLEAGLKEMLAYKGPVLVEVVVDKKIPVLPMVPAGKALHEFLVYDADAEAASRPDRLKNAPAPHVHQTTFEN

SEQ ID NO: 717 - DNA, 2094 bp, Aspergillus nidulans
atgatgcctttaagaccatcaaaaagcgccctgcgcactctgcattatcagaggtacattgcctctggacgaagagcctttgcttctgcggtctcgacgccccaccgcttttcgactcagaagcgcgaccagagcacagcaacggctactgcttcaacctcccgccctagacccagccctgccttcaaccaagagccaagccgcaatgaagtatcacctctccagaatcgacagcttcccgagctcgacgactcgtatggcattctcattcttttcgtccaaatattcgtcggactcagcggtggtgagatattccacgagatgatgctgcgcctgggtgtgaagcacgtttttggctaccctggaggtgccattcttcccgtcttcgacgcaatttacaactctaagcacttcgacttcatcctgcctcgacatgaacagggtgcgggccacatggcagaaggttatgctcgtgcttctgggaagcctggtgttgtccttgtcacttctggtcccggtgctaccaatgtcattactcccatgcaggacgccttctctgatggtacccccatggttgtcttctgtggtcaggttgtcactacctccatcggcacagactccttccaggaagccgacgtggttggtatctctagggcatgcaccaagtggaacgttatggtcaagtccgtcgccgaacttccccgccgtatccaagaagctttcgaaattgctactagcggtcgtcctggtcctgtcctcgtcgatcttcccaaggatatcaccgcaggtatcctccgtaaacccattcctatgcagagcactcttccttctcgcccgagcgccgcgactctggcggccaaggaattgagtgagaagcagcttcacagcaccatcaatcgcgtggcccgtctcgtcaacgtcgccaagaaacctgtactctacgttggtcagggtatcctcgaaaaccccgacggccccaaactcctgaaggagctggccgacaaggcttgcattcctgttactacaactttgcaaggtcttggcggctttgacgagctcgaccccaaatccctgcacatgcttggtatgcatggctctgcctatgcaaacttggctatgcaggaagccgatttgatcatcgcccttggtgctcgctttgatgatcgtgtgactggtagcatcgctaaatttgctccccaggctaagctcgctgcttcggaaaatcgtggtggtattgttcacttcgagatcatgccgaagaacatcaacaaggttgtgcaagcaaacgaggctgttgagggtgactgtgctgagaacattcgacacctccttcctcttgttgaacctgtctccgaaagaccagagtggtttgcccaaatcaatgactggaagacccggttcccgctctctctctacgagaaacagactcctgacggccccatcaagccgcaggctttgattgagaagctcagtgatcttactgctcacatgaaagaccgcactatcattaccactggtgttggacagcaccaaatgtgggccgcccagcacttccgttggcgccgtccccgctccatgatcacttctgggggtcttggtactatgggctacggcctgccggctgctattggtgccaaagttgcccgccctgactgccttgttatcgatatcgatggcgatgcctcctttaacatgactctcactgagcttaccactgctgcccagtttaacattggcatcaaggtccttctcttgaataacgaggagcagggcatggtgacccaatggcaaaacctgttctacgaggaccgctactcccacactcaccagaagaaccctgatttcgtgcgtcttgctgaggctatgggtgttgctgccgagcgctgcaccaagccctcagaagtggagtccaagctgaagtggctgatcgagagtgatggacctgccttgctcgaggtattcaccgaccgtaaggtgcccgtgttaccaatggttcctggtggtagcggcctgcacgagttcctcgttttcgacgaagccaaggaccgtgagaggagggctttaatgaagaaaaggaaccctaacggcgtttaa

SEQ ID NO: 718 - protein, 697 aa, Aspergillus nidulans
MMPLRPSKSALRTLHYQRYIASGRRAFASAVSTPHRFSTQKRDQSTATATASTSRPRPSPAFNQEPSRNEVSPLQNRQLPELDDSYGILILFVQIFVGLSGGEIFHEMMLRLGVKHVFGYPGGAILPVFDAIYNSKHFDFILPRHEQGAGHMAEGYARASGKPGVVLVTSGPGATNVITPMQDAFSDGTPMVVFCGQVVTTSIGTDSFQEADVVGISRACTKWNVMVKSVAELPRRIQEAFEIATSGRPGPVLVDLPKDITAGILRKPIPMQSTLPSRPSAATLAAKELSEKQLHSTINRVARLVNVAKKPVLYVGQGILENPDGPKLLKELADKACIPVTTTLQGLGGFDELDPKSLHMLGMHGSAYANLAMQEADLIIALGARFDDRVTGSIAKFAPQAKLAASENRGGIVHFEIMPKNINKVVQANEAVEGDCAENIRHLLPLVEPVSERPEWFAQINDWKTRFPLSLYEKQTPDGPIKPQALIEKLSDLTAHMKDRTIITTGVGQHQMWAAQHFRWRRPRSMITSGGLGTMGYGLPAAIGAKVARPDCLVIDIDGDASFNMTLTELTTAAQFNIGIKVLLLNNEEQGMVTQWQNLFYEDRYSHTHQKNPDFVRLAEAMGVAAERCTKPSEVESKLKWLIESDGPALLEVFTDRKVPVLPMVPGGSGLHEFLVFDEAKDRERRALMKKRNPNGV

SEQ ID NO: 719 - DNA, 1245 bp, Saccharomyces cerevisiae
atgtttgtcagggttaaattgaataaaccagtaaaatggtataggttctatagtacgttggattcacattccctaaagttacagagcggctcgaagtttgtaaaaataaagccagtaaataacttgaggagtagttcatcagcagatttcgtgtccccaccaaattccaaattacaatctttaatctggcagaaccctttacaaaatgtttatataactaaaaaaccatggactccatccacaagagaagcgatggttgaattcataactcatttacatgagtcataccccgaggtgaacgtcattgttcaacccgatgtggcagaagaaatttcccaggatttcaaatctcctttggagaatgatcccaaccgacctcatatactttatactggtcctgaacaagatatcgtaaacagaacagacttattggtgacattgggaggtgatgggactattttacacggcgtatcaatgttcggaaatacgcaagttcctccggttttagcatttgctctgggcactctgggctttctatcaccgtttgattttaaggagcataaaaaggtctttcaggaagtaatcagctctagagccaaatgtttgcatagaacacggctagaatgtcatttgaaaaaaaaggatagcaactcatctattgtgacccatgctatgaatgacatattcttacataggggtaattcccctcatctcactaacctggacattttcattgatggggaatttttgacaagaacgacagcagatggtgttgcattggccactccaacgggttccacagcatattcattatcagcaggtggatctattgtttccccattagtccctgctattttaatgacaccaatttgtcctcgctctttgtcattccgaccactgattttgcctcattcatcccacattaggataaagataggttccaaattgaaccaaaaaccagtcaacagtgtggtaaaactttctgttgatggtattcctcaacaggatttagatgttggtgatgaaatttatgttataaatgaggtcggcactatatacatagatggtactcagcttccgacgacaagaaaaactgaaaatgactttaataattcaaaaaagcctaaaaggtcagggatttattgtgtcgccaagaccgagaatgactggattagaggaatcaatgaacttttaggattcaattctagctttaggctgaccaagagacagactgataatgattaa

SEQ ID NO: 720 - protein, 414 aa, Saccharomyces cerevisiae
MFVRVKLNKPVKWYRFYSTLDSHSLKLQSGSKFVKIKPVNNLRSSSSADFVSPPNSKLQSLIWQNPLQNVYITKKPWTPSTREAMVEFITHLHESYPEVNVIVQPDVAEEISQDFKSPLENDPNRPHILYTGPEQDIVNRTDLLVTLGGDGTILHGVSMFGNTQVPPVLAFALGTLGFLSPFDFKEHKKVFQEVISSRAKCLHRTRLECHLKKKDSNSSIVTHAMNDIFLHRGNSPHLTNLDIFIDGEFLTRTTADGVALATPTGSTAYSLSAGGSIVSPLVPAILMTPICPRSLSFRPLILPHSSHIRIKIGSKLNQKPVNSVVKLSVDGIPQQDLDVGDEIYVINEVGTIYIDGTQLPTTRKTENDFNNSKKPKRSGIYCVAKTENDWIRGINELLGFNSSFRLTKRQTDND

SEQ ID NO: 721 - DNA, 1296 bp, Candida glabrata
atgctgacttcatatagaattcttccaaggagagttcttctgagtggtgtcaatagagctattattcgttactacagtcccgatattggcggtgcaaatgtcggcaaaggaagattcgtaaagataaagcctgtctctaatctaagggcatccacagctgctgacttcttcacatctccaaactcaaaattacaatcgctagtgtggagaaacccgttacagaatgtcctagtcaccaagaagccatggacccctacgacaagagaagccatggtccagttcattacacatctgcatgagtcataccccgagattaacgttatagttcaacctgatgttgctgaagagatttcccaggatttcaaagccactgttcataatgatccaaacagaccgcatctactatttactggtacagaagaagatatagccacaagaacagatttattggttacactaggaggtgacggtaccattttgcatagcgtttctatgtttggtgataagatcgcacctcccgtacttgcattttcacttggtacattggggtttctactaccatttgatttcaaagagcacgagaaagtgttctctcaagtgataagttccagagctaaatgtctccacagaactagattgcaatgtcatgtggtgcgtaacggtaatagcacgccaattgtagcacacgctatgaatgatatattcttacatagaggtaactcacctcacctaactaatcttgacatctatatcgatggcgagtatttgacaaggactactgccgatggtgtcactttgtctaccccaacggggtctactgcatattctttatccgctggtggctcaatcgtgtcgccattagtgccatctatattgctaactcctatctgtccacgttctctatcgtttagacctttaatattaccacactcaagttacataaagataaaagtggaatcaaagatgaacatgaatgtggctaatcatattgtcaagctatcgattgatggtattccacaggaggatttagttgcgggtgatgagattcatgtgattaatgaagttggaactatctacattgatgggactcaattccctattgcagctaagaaacaaacagctgataaagccactattaccggcaagactccagataaagacgtacaaaagagatccggtatatactgtgttgctaaaacagagaacgattggatcaaaggtatcaatgaattgctgggattcaattccagtttcaggttcatccatagaggcaaggacgacgatgaaaaaaaatga

SEQ ID NO: 722 - protein, 431 aa, Candida glabrata
MLTSYRILPRRVLLSGVNRAIIRYYSPDIGGANVGKGRFVKIKPVSNLRASTAADFFTSPNSKLQSLVWRNPLQNVLVTKKPWTPTTREAMVQFITHLHESYPEINVIVQPDVAEEISQDFKATVHNDPNRPHLLFTGTEEDIATRTDLLVTLGGDGTILHSVSMFGDKIAPPVLAFSLGTLGFLLPFDFKEHEKVFSQVISSRAKCLHRTRLQCHVVRNGNSTPIVAHAMNDIFLHRGNSPHLTNLDIYIDGEYLTRTTADGVTLSTPTGSTAYSLSAGGSIVSPLVPSILLTPICPRSLSFRPLILPHSSYIKIKVESKMNMNVANHIVKLSIDGIPQEDLVAGDEIHVINEVGTIYIDGTQFPIAAKKQTADKATITGKTPDKDVQKRSGIYCVAKTENDWIKGINELLGFNSSFRFIHRGKDDDEKK

SEQ ID NO: 723 - DNA, 1263 bp, Kluveromyces lactis
atggtgatacttctcagaggaaggttaaatgttcctagcatttggtcactggcccgtcagcagcatgtttcaggtttgtttcagtgcgctaggttttattctgaggtaagacttcgagattcttcgaagtttgttgctttgaaagatgtaaacgatctacgggcaaccagcttgccagatttcatatcttccccaaattcgaaactacaatcgttgatatggcaccgtcctatgcaaaacgtgtttttaatgaagaaaccttggactgataccactagggaggccatggttgagttcatcacacacttgcacgattcttacccagaagtcaacgttatagtgcaaccagatgtggcagaagaaatatcacaagatttcagatcgatgcctaaatcgaatccaaatcaaccgcatgttctatatacgggctcggacgctgacattgtcaaaaagacggatctcttggtgactcttggtggcgatgggacgattctcagatccgtttcgttgttctcacatactcaggtcccacctgtacttgccttcagtctaggaactttggggttcctactaccgtttgctttcaaagagcataagaaaatcttcgaacaagtgatgacttctagagccaaatgtcttcatagaacgagactagagtgtcatttggtaagaaatggcaagacgcagcaaactacaactttacatgcgatgaacgatatctttttacatagaggtaactcaccacatttgaccaatttggatatatacatcgatggtgagtttatgacaaggactactgccgatggtgtgactttatccacgcctaccggatctacggcatactctttatctgcaggcggaagtattgtgtctcccttggttccctcgatcttattaaccccgatttgccctaggtcactttcgttccgtcccttgatcttacctcacacttctcatatcaagataaaaatcggttcgaaacacactggcggtccagacggccgcgttgtgaaattatccatcgatggtattcctcaggaagatgtatacgtgaacgatgaaattcatgtcgtcaacgaagtaggaaccatctatgtgaatgggtccaaattaccaatacctcaagaagcaatcaagtcacaaaagacatcgctcaagaactctggaatctactgcgtggccaagactgaaaacgactggattaaaggcatcaatgagctattgggtttcaattcaagtttcaggttcggttcaaagtcatag

SEQ ID NO: 724 - protein, 420 aa, Kluveromyces lactis
MVILLRGRLNVPSIWSLARQQHVSGLFQCARFYSEVRLRDSSKFVALKDVNDLRATSLPDFISSPNSKLQSLIWHRPMQNVFLMKKPWTDTTREAMVEFITHLHDSYPEVNVIVQPDVAEEISQDFRSMPKSNPNQPHVLYTGSDADIVKKTDLLVTLGGDGTILRSVSLFSHTQVPPVLAFSLGTLGFLLPFAFKEHKKIFEQVMTSRAKCLHRTRLECHLVRNGKTQQTTTLHAMNDIFLHRGNSPHLTNLDIYIDGEFMTRTTADGVTLSTPTGSTAYSLSAGGSIVSPLVPSILLTPICPRSLSFRPLILPHTSHIKIKIGSKHTGGPDGRVVKLSIDGIPQEDVYVNDEIHVVNEVGTIYVNGSKLPIPQEAIKSQKTSLKNSGIYCVAKTENDWIKGINELLGFNSSFRFGSKS

SEQ ID NO: 725 - DNA, 1149 bp, Pichia stipitis
atggctaacttaatagacataagactggttacccagcttggcaatgccaaattcccagagtatgtgcaacagtcccattccaagttgcacaacgtcatctggagaacaccgcttcaaaacatatacgtagtaaaaaaaccatggaattaccacgtccgtgatgcaatggtacagttcattgaccacatccaccaccattacccagcagtaaacgtcatagtcaacgaagacgtagcagacgagttggtccacgagttcagttcggggggttgcaacgacttggataaatcaacaaaacatatcttgtacacgggaaaatttggcgacatcgtagacaaaacagacttggtggtgacgttaggtggcgatggtacgattctacgtgctgtgagtactttcctgaatgtgaccgttcctcccgttctaagttttgctttgggaacgttggggttccttttgccgtttgacttcaagaaggccagcgacacgttccgtatggtctatgagtcgcgagccaaggcacttcatagaaacagactcgagtgtcatgtattggaccattataaacaccagggacaggttgccaccatggtgcatgctatgaatgatatctcgttgcatagaggaagtcagcccaacttgacgtcgttggatatctacatcgacaacgagttcttgactactaccacggcagacggtattgtctttctgactcctacaggttctacagcgtactcgcttagtgctggtggctctatcactcatccgttggttccgtgcatattgcttacgcccatctgtcctagatcgttgtcgttcaggccattgatcttgcctctgacatgccatatcatgatccgattgtcagaactcaaccggaactcgtctattgagttgaccatcgatggaatcccacagagagacttacttcccggagactctatacatgtagtcagcgaaaaaggtaccatatatgtgcctggccaacacgagccacctaccactctcagcagacataccaacaccgcgaacaccaatagtaagggcatctggtgcatagcccgcagcgagcacgattggacgaaggacatcaacgagttgttgggattcaactcgtcgttccagggcaagaagcagtaccatatgtag

SEQ ID NO: 726 - protein, 382 aa, Pichia stipitis
MANLIDIRSVTQLGNAKFPEYVQQSHSKLHNVIWRTPLQNIYVVKKPWNYHVRDAMVQFIDHIHHHYPAVNVIVNEDVADELVHEFSSGGCNDLDKSTKHILYTGKFGDIVDKTDLVVTLGGDGTILRAVSTFSNVTVPPVLSFALGTLGFLLPFDFKKASDTFRMVYESRAKALHRNRLECHVLDHYKHQGQVATMVHAMNDISLHRGSQPNLTSLDIYIDNEFLTTTTADGIVFSTPTGSTAYSLSAGGSITHPLVPCILLTPICPRSLSFRPLILPSTCHIMIRLSELNRNSSIELTIDGIPQRDLLPGDSIHVVSEKGTIYVPGQHEPPTTLSRHTNTANTNSKGIWCIARSEHDWTKDINELLGFNSSFQGKKQYHM

SEQ ID NO: 727 - DNA, 2064 bp, Saccharomyces cerevisiae
atgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactga

SEQ ID NO: 728 - protein, 687 aa, Saccharomyces cerevisiae [sequence omitted]

SEQ ID NO: 729 - DNA, 1449 bp, Saccharomyces cerevisiae
  CDS (1)..(1449)
atgtctgcctttgtcagggtggttccaagaatatccagaagttcagtactcaccagatcattgagactgcaattgagatgctacgcatcgtacccagagcacaccattattggtatgccggcactgtctcctacgatgacgcaaggtaatcttgctgcttggactaagaaggaaggtgaccaattgtctcccggtgaagttattgccgaaatagaaacagacaaggctcaaatggactttgagttccaagaagatggttacttagccaagattctagttcctgaaggtacaaaggacattcctgtcaacaagcctattgccgtctatgtggaggacaaagctgatgtgccagcttttaaggactttaagctggaggattcaggttctgattcaaagaccagtacgaaggctcagcctgccgaaccacaggcagaaaagaaacaagaagcgccagctgaagagaccaagacttctgcacctgaagctaagaaatctgacgttgctgctcctcaaggtaggatttttgcctctccacttgccaagactatcgccttggaaaagggtatttctttgaaggatgttcacggcactggaccccgcggtagaattaccaaggctgacattgagtcatatctagaaaagtcgtctaagcagtcttctcaaaccagtggtgctgccgccgccactcctgccgccgctacctcaagcactactgctggctctgctccatcgccttcttctacagcatcatatgaggatgttccaatttcaaccatgagaagcatcattggagaacgtttattgcaatctactcaaggcattccatcatacatcgtttcctccaagatatccatctccaaacttttgaaattgagacagtccttgaacgctacagcaaacgacaagtacaaactgtccattaatgacctattagtaaaagccatcactgttgcggctaagagggtgccagatgccaatgcctactggttacctaatgagaacgttatccgtaaattcaagaatgtcgatgtctcagtcgctgttgccacaccaacaggattattgacaccaattgtcaagaattgtgaggccaagggcttgtcgcaaatctctaacgaaatcaaggaactagtcaagcgtgccagaataaacaaattggcaccagaggaattccaaggtgggaccatttgcatatccaatatgggcatgaataatgctgttaacatgtttacttcgattatcaacccaccacagtctacaatcttggccatcgctactgttgaaagggtcgctgtggaagacgccgctgctgagaacggattctcctttgataaccaggttaccataacagggacctttgatcatagaaccattgatggcgccaaaggtgcagaattcatgaaggaattgaaaactgttattgaaaatcctttggaaatgctattgtga

SEQ ID NO: 730 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 731 - DNA, 1500 bp, Saccharomyces cerevisiae
  CDS (1)..(1500)
atgttaagaatcagatcactcctaaataataagcgtgccttttcgtccacagtcaggacattgaccattaacaagtcacatgatgtagtcatcatcggtggtggccctgctggttacgtggctgctatcaaagctgctcaattgggatttaacactgcatgtgtagaaaaaagaggcaaattaggcggtacctgtcttaacgttggatgtatcccctccaaagcacttctaaataattctcatttattccaccaaatgcatacggaagcgcaaaagagaggtattgacgtcaacggtgatatcaaaattaacgtagcaaacttccaaaaggctaaggatgacgctgttaagcaattaactggaggtattgagcttctgttcaagaaaaataaggtcacctattataaaggtaatggttcattcgaagacgaaacgaagatcagagtaactcccgttgatgggttggaaggcactgtcaaggaagaccacatactagatgttaagaacatcatagtcgccacgggctctgaagttacacccttccccggtattgaaatagatgaggaaaaaattgtctcttcaacaggtgctctttcgttaaaggaaattcccaaaagattaaccatcattggtggaggaatcatcggattggaaatgggttcagtttactctagattaggctccaaggttactgtagtagaatttcaacctcaaattggtgcatctatggacggcgaggttgccaaagccacccaaaagttcttgaaaaagcaaggtttggacttcaaattaagcaccaaagttatttctgcaaagagaaacgacgacaagaacgtcgtcgaaattgttgtagaagatactaaaacgaataagcaagaaaatttggaagctgaagttttgctggttgctgttggtagaagaccttacattgctggcttaggggctgaaaagattggattagaagtagacaaaaggggacgcctagtcattgatgaccaatttaattccaagttcccacacattaaagtggtaggagatgttacatttggtccaatgctggctcacaaagccgaagaggaaggtattgcagctgtcgaaatgttgaaaactggtcacggtcatgtcaactataacaacattccttcggtcatgtattctcacccagaagtagcatgggttggtaaaaccgaagagcaattgaaagaagccggcattgactataaaattggtaagttcccctttgcggccaattcaagagccaagaccaaccaagacactgaaggtttcgtgaagattttgatcgattccaagaccgagcgtattttgggggctcacattatcggtccaaatgccggtgaaatgattgctgaagctggcttagccttagaatatggcgcttccgcagaagatgttgctagggtctgccatgctcatcctactttgtccgaagcatttaaggaagctaacatggctgcctatgataaagctattcattgttga

SEQ ID NO: 732 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 733 - DNA, 1233 bp, Saccharomyces cerevisiae
  CDS (1)..(1233)
atgctaagtgcaatttccaaagtctccactttaaaatcatgtacaagatatttaaccaaatgcaactatcatgcatcagctaaattacttgctgtaaagacattttcaatgcctgcaatgtctcctactatggagaaaggggggattgtgtcttggaaatataaagttggcgaaccattcagcgcgggcgatgtgatattagaagtggaaacagataaatctcaaattgatgtggaagcactggacgatggtaaactagctaagatcctgaaagatgaaggctctaaagatgttgatgttggtgaacctattgcttatattgctgatgttgatgatgatttagctactataaagttaccccaagaggccaacaccgcaaatgcgaaatctattgaaattaagaagccatccgcagatagtactgaagcaacacaacaacatttaaaaaaagccacagttacaccaataaaaaccgttgacggcagccaagccaatcttgaacagacgctattaccatccgtgtcattactactggctgagaacaatatatccaaacaaaaggctttgaaggaaattgcgccatctggttccaacggtagactattaaagggtgatgtgctagcatacctagggaaaataccacaagattcggttaacaaggtaacagaatttatcaagaagaacgaacgtctcgatttatcgaacattaaacctatacagctcaaaccaaaaatagccgagcaagctcaaacaaaagctgccgacaagccaaagattactcctgtagaatttgaagagcaattagtgttccatgctcccgcctctattccgtttgacaaactgagtgaatcattgaactctttcatgaaagaagcttaccagttctcacacggaacaccactaatggacacaaattcgaaatactttgaccctattttcgaggaccttgtcaccttgagcccaagagagccaagatttaaattttcctatgacttgatgcaaattcccaaagctaataacatgcaagacacgtacggtcaagaagacatatttgacctcttaacaggttcagacgcgactgcctcatcagtaagacccgttgaaaagaacttacctgaaaaaaacgaatatatactagcgttgaatgttagcgtcaacaacaagaagtttaatgacgcggaggccaaggcaaaaagattccttgattacgtaagggagttagaatcattttga

SEQ ID NO: 734 - protein, 410 aa, Saccharomyces cerevisiae
MLSAISKVSTLKSCTRYLTKCNYHASAKLLAVKTFSMPAMSPTMEKGGIVSWKYKVGEPFSAGDVILEVETDKSQIDVEALDDGKLAKILKDEGSKDVDVGEPIAYIADVDDDLATIKLPQEANTANAKSIEIKKPSADSTEATQQHLKKATVTPIKTVDGSQANLEQTLLPSVSLLLAENNISKQKALKEIAPSGSNGRLLKGDVLAYLGKIPQDSVNKVTEFIKKNERLDLSNIKPIQLKPKIAEQAQTKAADKPKITPVEFEEQLVFHAPASIPFDKLSESLNSFMKEAYQFSHGTPLMDTNSKYFDPIFEDLVTLSPREPRFKFSYDLMQIPKANNMQDTYGQEDIFDLLTGSDATASSVRPVEKNLPEKNEYILALNVSVNNKKFNDAEAKAKRFLDYVRELESF

SEQ ID NO: 735 - DNA, 1803 bp, Schizosaccharomyces pombe
atgactggaacgagtttttacacttcggtactcagattgggacgattggctcaacagggcctaaaattccaatctgtaaaacatattcgtccatcatgtttttcatcttttggattacaagctaaacgttggaactctactcaacaaaatgatagttctattgattgtttagaacctaagctgcaaggaattattgaagacaatatttctccctcgacggcacaaaaagaaatatcagacatcaagtttaatattccaaaggaaatgcttcttccagatggaactcctgattatttacgtttgactctcacgtctaacgtgtatgaagttatcaaggagactcctcttacaaagggtgttgtcatttctgaaagtaccggtgttccagtctacttaaaacgtgaagatctcactcctgtgttttcatttaaaattcgaggggctcataataaaatggcttctcttgataagcagtcattgaaaaatggagtcattgcttgttccgctggcaatcacgcccagggtgttgcttactccgctaggactcttggtgtaaaagctaccattgttatgcctcagaatactcctgaaatcaaatggaggaacgttaagagattgggcgctaatgttctcttacatggagctaattttgacattgctaaagcagaatgtgcacgtttggctaaagagcaaaatctcgaagttattcatccctttgacgatccttatgtaattgctggacaaggaaccattggacttgaaattcttcatcaaatagatcttcgcaagctggatgctatttactgcgctgttggcggtggtggtttaattgctggaatagctacttacgttaagcgtattgctccccatgttaaggtcattggtgtcgagacatttgacgctgatgctttaaaaaagtctttgaaggacaaaaagcgggtaacccttaaggaagttggcttattcgctgatggaactgctgtgaaacttgttggagaggaaaccttccgtcttgtctccaagaatattgacgatgtagttcttgttgacaaagatgagatttgtgcagccattaaggatgtttttttggatacccgttcagtggtcgaaccatcaggagctatggctgttgctggtatgaagcgttatgtcgctaaacacaagcctaaaaatcccaatgctgctcaggtttgcatcttaagtggtgccaatatggactttgatcgccttagatttattgctgagcgtgctgatcttggtttgaacaaggaagtattcttgagtgtcactattcctgagcgccctggttcatttgaagccctacacaacattattactccacgtagtattaccgaattttcttatcgttacgataatgatgactatgctaacatttacacatcgtttgtggtaaaggaccgtgcaactgaattgcctttgattcttcaacaaatctctgagcaaaatatggttgcagaagatatcagcgataatgaacttgctaaaactcatgcccgttatcttattggaggaaaatcatctgtttcaaaagagcgtttgtaccgattggatttccctgaacgccctggagctttatgtaagtttttgaggagtataaaggaagtttgcagcatttcccttttccattatcgtaattgtggtggagatatagctagtgtgcttgctggccttagagtttttgatggccaagtggaaaaacttcattcagttttggaagagattggatacaactgggtggacgaaacaaataatcccgtttacttgcgctatcttcgtaaatag

SEQ ID NO: 736 - DNA, 1692 bp, Saccharomyces cerevisiae
  CDS (1)..(1692)
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 737 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 738 - DNA, 1692 bp, Saccharomyces cerevisiaee
  CDS (1)..(1692)
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 739 - protein, 563 aa, Saccharomyces cerevisiaee
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 740 - DNA, 1599 bp, Saccharomyces cerevisiae
  CDS (1)..(1599)
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 741 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 742 - DNA, 1695 bp, Candida glabrata
  CDS (1)..(1695)
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaataa

SEQ ID NO: 743 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 744 - DNA, 1791 bp, Pichia stipitis
  CDS (1)..(1791)
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagcttag

SEQ ID NO: 745 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSLNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 746 - DNA, 1710 bp, Pichia stipitis
  CDS (1)..(1710)
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaattga

SEQ ID NO: 747 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 748 - DNA, 1692 bp, Kluyveromyces lactis
  CDS (1)..(1692)
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaactaa

SEQ ID NO: 749 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 750 - DNA, 1716 bp, Yarrowia lipolytica
  CDS (1)..(1716)
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 751 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 752 - DNA, 1716 bp, Schizosaccharomyces pombe
  CDS (1)..(1716)
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 753 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

What is claimed is:

1. A recombinant yeast cell comprising a heterologous gene encoding a mitochondrial localized polypeptide having α-keto acid decarboxylase activity and wherein the mitochondria is substantially devoid of a functional polypeptide having threonine deaminase activity and a functional polypeptide having isopropylmalate synthase activity.

2. The yeast cell of claim 1 wherein the cell produces isobutanol in the mitochondria.

3. The yeast cell of claim 2 wherein the cell further comprises genes encoding mitochondrial localized polypeptides having ketol-acid reductoisomerase activity and dihydroxy-acid dehydratase activity which are overexpressed.

4. The yeast cell of claim 3 wherein the mitochondria is further substantially devoid of a functional polypeptide having an enzyme activity selected from branched chain amino acid transaminase activity, pyruvate dehydrogenase activity, or a combination thereof.

5. The yeast cell of claim 1 selected from the group consisting of *Saccharomyces, Schizosaccharomyces, Hansenula, Candida, Kluyveromyces, Yarrowia* and *Pichia*.

6. The yeast cell of claim 1 wherein the α-keto acid decarboxylase activity is defined by the enzyme classification number EC 4.1.1.72.

7. The yeast cell of claim 4 wherein:

a) the threonine deaminase activity is defined by the enzyme classification number EC 4.3.1.19;

b) the isopropylmalate synthase activity is defined by the enzyme classification number EC 2.3.3.13;

c) the branched chain amino acid transaminase activity is defined by the enzyme classification number EC 2.6.1.42; and d) the pyruvate dehydrogenase activity is defined by the enzyme classification number EC 1.2.4.1.

8. The yeast cell of claim 4 wherein the polypeptide having the pyruvate dehydrogenase activity is a multienzyme complex comprising proteins selected from the group consisting of: PDA1, PDA1, PDB1, LAT1, LPD1, and PDX1.

9. A method for making isobutanol comprising growing the yeast host cell of any of claim 3, and 4 under conditions whereby isobutanol is produced.

* * * * *